United States Patent
Shepard et al.

(10) Patent No.: US 9,278,124 B2
(45) Date of Patent: Mar. 8, 2016

(54) HYPOXIA AND HYALURONAN AND MARKERS THEREOF FOR DIAGNOSIS AND MONITORING OF DISEASES AND CONDITIONS AND RELATED METHODS

(71) Applicants: H. Michael Shepard, San Diego, CA (US); Xiaoming Li, San Diego, CA (US); Curtis Thompson, Encinitas, CA (US)

(72) Inventors: H. Michael Shepard, San Diego, CA (US); Xiaoming Li, San Diego, CA (US); Curtis Thompson, Encinitas, CA (US)

(73) Assignee: Halozyme, Inc., San Diego, CA (US)

( * ) Notice: Subject to any disclaimer, the term of this patent is extended or adjusted under 35 U.S.C. 154(b) by 0 days.

(21) Appl. No.: 13/998,269

(22) Filed: Oct. 16, 2013

(65) Prior Publication Data

US 2014/0105824 A1    Apr. 17, 2014

Related U.S. Application Data

(60) Provisional application No. 61/852,177, filed on Mar. 14, 2013, provisional application No. 61/714,718, filed on Oct. 16, 2012.

(51) Int. Cl.
| | |
|---|---|
| *A61K 38/47* | (2006.01) |
| *A61K 31/407* | (2006.01) |
| *A61K 31/396* | (2006.01) |
| *A61K 31/4709* | (2006.01) |
| *A61K 31/53* | (2006.01) |
| *A61K 31/473* | (2006.01) |
| *A61K 38/40* | (2006.01) |
| *A61K 38/31* | (2006.01) |
| *A61K 38/18* | (2006.01) |
| *A61K 31/519* | (2006.01) |
| *A61K 31/56* | (2006.01) |
| *G01N 33/566* | (2006.01) |
| *G01N 33/574* | (2006.01) |

(52) U.S. Cl.
CPC ............... *A61K 38/47* (2013.01); *A61K 31/396* (2013.01); *A61K 31/407* (2013.01); *A61K 31/473* (2013.01); *A61K 31/4709* (2013.01); *A61K 31/519* (2013.01); *A61K 31/53* (2013.01); *A61K 31/56* (2013.01); *A61K 38/1808* (2013.01); *A61K 38/31* (2013.01); *A61K 38/40* (2013.01); *G01N 33/566* (2013.01); *G01N 33/574* (2013.01)

(58) Field of Classification Search
CPC .............................. A61K 38/47; A61K 31/407
See application file for complete search history.

(56) References Cited

U.S. PATENT DOCUMENTS

| | | | |
|---|---|---|---|
| 2,488,564 A | 11/1949 | Singher et al. | 435/201 |
| 2,488,565 A | 11/1949 | Singher et al. | 435/201 |
| 2,676,139 A | 4/1954 | Tint et al. | 424/201 |
| 2,795,529 A | 6/1957 | Alburn et al. | 424/94.3 |
| 2,806,815 A | 9/1957 | Orlando | 435/188 |
| 2,808,362 A | 10/1957 | Thompson et al. | 435/201 |
| 3,226,393 A | 12/1965 | Walter et al. | 260/295 |
| 3,272,696 A | 9/1966 | O'Connell | 167/30 |
| 3,306,821 A | 2/1967 | Schroeder | 167/65 |
| 3,320,132 A | 5/1967 | Evans | 167/78 |
| 3,332,944 A | 7/1967 | Donna et al. | 260/247.2 |
| 3,536,809 A | 10/1970 | Applezweig | 424/28 |
| 3,539,794 A | 11/1970 | Zaffaroni | 240/2.25 |
| 3,598,123 A | 8/1971 | Zaffaroni | 424/435 |
| 3,630,200 A | 12/1971 | Higuchi | 424/427 |
| 3,660,578 A | 5/1972 | Hata et al. | 424/274 |
| 3,710,795 A | 1/1973 | Higuchi et al. | 424/424 |
| 3,845,770 A | 11/1974 | Theeuwes et al. | 424/427 |
| 3,916,899 A | 11/1975 | Theeuwes et al. | 424/424 |
| 3,957,779 A | 5/1976 | Seng et al. | 260/249.5 |
| 4,002,531 A | 1/1977 | Royer | 435/188 |
| 4,008,719 A | 2/1977 | Theeuwes et al. | 424/427 |
| 4,179,337 A | 12/1979 | Davis et al. | 435/181 |
| 4,687,660 A | 8/1987 | Baker et al. | 424/465 |
| 4,751,180 A | 6/1988 | Cousens et al. | 435/68 |
| 4,769,027 A | 9/1988 | Baker et al. | 424/493 |
| 4,935,233 A | 6/1990 | Bell et al. | 424/85.5 |
| 5,033,252 A | 7/1991 | Carter | 53/425 |
| 5,052,558 A | 10/1991 | Carter | 206/439 |
| 5,059,595 A | 10/1991 | Le Grazie | 424/468 |
| 5,073,543 A | 12/1991 | Marshall et al. | 514/21 |
| 5,116,964 A | 5/1992 | Capon et al. | 536/27 |
| 5,120,548 A | 6/1992 | McClelland et al. | 424/473 |
| 5,122,614 A | 6/1992 | Zalipsky | 548/520 |
| 5,132,327 A | 7/1992 | Patterson | 552/255 |
| 5,171,081 A | 12/1992 | Pita et al. | 362/101 |
| 5,175,287 A | 12/1992 | Lee et al. | 544/122 |
| 5,180,670 A | 1/1993 | Iwata et al. | 435/119 |
| 5,323,907 A | 6/1994 | Kalvelage | 206/531 |
| 5,324,844 A | 6/1994 | Zalipsky | 548/520 |

(Continued)

FOREIGN PATENT DOCUMENTS

| | | |
|---|---|---|
| CN | 101899118 | 12/2010 |
| EP | 0400472 | 12/1990 |

(Continued)

OTHER PUBLICATIONS

Ropponen et al. (Cancer Research. Jan. 15, 1998; 58: 342-347).*

(Continued)

*Primary Examiner* — Scott Long
(74) *Attorney, Agent, or Firm* — Dentons US LLP; Stephanie Seidman

(57) ABSTRACT

Provided herein are diagnostic methods for identifying subjects susceptible to treatment with a hypoxia-activated agent, and related methods. Also provided herein are methods of monitoring treatments with anti-hyaluronan agents, and related methods.

51 Claims, No Drawings

(56) References Cited

U.S. PATENT DOCUMENTS

| | | | |
|---|---|---|---|
| 5,348,977 A | 9/1994 | Denny et al. | 424/617 |
| 5,354,556 A | 10/1994 | Sparks | 424/419 |
| 5,446,090 A | 8/1995 | Harris | 525/54.1 |
| 5,447,950 A | 9/1995 | Patterson | 514/403 |
| 5,457,035 A | 10/1995 | Baum et al. | 435/69.5 |
| 5,461,078 A | 10/1995 | Patterson | 514/641 |
| 5,554,648 A | 9/1996 | Denny et al. | 514/501 |
| 5,591,767 A | 1/1997 | Mohr et al. | 514/413 |
| 5,612,460 A | 3/1997 | Zalipsky | 530/391.9 |
| 5,639,476 A | 6/1997 | Oshlack et al. | 424/468 |
| 5,643,575 A | 7/1997 | Martinez et al. | 424/194.1 |
| 5,672,662 A | 9/1997 | Harris et al. | 525/408 |
| 5,672,702 A | 9/1997 | Philion | 544/183 |
| 5,674,533 A | 10/1997 | Santus et al. | 424/493 |
| 5,731,168 A | 3/1998 | Carter et al. | 435/69.1 |
| 5,733,566 A | 3/1998 | Lewis | 424/426 |
| 5,747,027 A | 5/1998 | Stern et al. | 424/94.62 |
| 5,766,581 A | 6/1998 | Bartley et al. | 424/85.1 |
| 5,795,569 A | 8/1998 | Bartley et al. | 424/85.1 |
| 5,808,096 A | 9/1998 | Zalipsky | 548/520 |
| 5,827,721 A | 10/1998 | Stern et al. | 435/201 |
| 5,900,461 A | 5/1999 | Harris | 525/54.11 |
| 5,919,455 A | 7/1999 | Greenwald et al. | 424/178.1 |
| 5,932,462 A | 8/1999 | Harris et al. | 435/188 |
| 5,985,263 A | 11/1999 | Lee et al. | 424/85.2 |
| 5,990,237 A | 11/1999 | Bentley et al. | 525/54.2 |
| 6,054,569 A | 4/2000 | Bennett et al. | 424/945 |
| 6,063,780 A | 5/2000 | Dexter et al. | 514/243 |
| 6,113,906 A | 9/2000 | Greenwald et al. | 424/194.1 |
| 6,121,263 A | 9/2000 | Brown | 514/243 |
| 6,156,744 A | 12/2000 | Ross et al. | 514/243 |
| 6,193,963 B1 | 2/2001 | Stern et al. | 424/94.6 |
| 6,214,966 B1 | 4/2001 | Harris | 528/322 |
| 6,258,351 B1 | 7/2001 | Harris | 424/78.3 |
| 6,277,835 B1 | 8/2001 | Brown | 514/110 |
| 6,319,923 B1 | 11/2001 | Dexter et al. | 424/649 |
| 6,320,063 B1 | 11/2001 | Denny et al. | 552/247 |
| 6,340,742 B1 | 1/2002 | Burg et al. | 530/351 |
| 6,413,507 B1 | 7/2002 | Bentley et al. | 424/78 |
| 6,420,339 B1 | 7/2002 | Gegg et al. | 514/12 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,495,659 B2 | 12/2002 | Bentley et al. | 528/425 |
| 6,737,505 B2 | 5/2004 | Bentley et al. | 528/425 |
| 6,828,401 B2 | 12/2004 | Nho et al. | 526/333 |
| 6,858,736 B2 | 2/2005 | Nho et al. | 546/290 |
| 6,872,546 B1 * | 3/2005 | Hastings | C07K 14/705 435/252.3 |
| 6,878,714 B2 | 4/2005 | Askew et al. | 514/256 |
| 6,894,071 B2 | 5/2005 | Nuijen et al. | 424/489 |
| 7,074,853 B2 | 7/2006 | Smith et al. | 524/860 |
| 7,105,330 B2 | 9/2006 | Stern et al. | 435/200 |
| 7,148,201 B2 | 12/2006 | Stern et al. | 514/44 R |
| 7,153,670 B2 | 12/2006 | Hastings et al. | 435/69.1 |
| 7,219,016 B2 | 5/2007 | Rimm et al. | 702/19 |
| 7,257,268 B2 | 8/2007 | Eichhorn et al. | 382/253 |
| 7,276,537 B2 | 10/2007 | Denny et al. | 514/644 |
| 7,405,317 B2 | 7/2008 | Lin et al. | 558/154 |
| 7,550,496 B2 | 6/2009 | Matteucci et al. | 514/396 |
| 7,646,905 B2 | 1/2010 | Guittet et al. | 382/133 |
| 7,718,688 B2 | 5/2010 | Denny et al. | 514/411 |
| 7,723,472 B2 | 5/2010 | Szoka et al. | 530/324 |
| 7,767,429 B2 | 8/2010 | Frost et al. | 435/201 |
| 7,781,397 B2 | 8/2010 | Stern et al. | 424/94.62 |
| 7,816,521 B2 | 10/2010 | Denny et al. | 514/231.5 |
| 7,829,081 B2 | 11/2010 | Bookbinder et al. | 424/94.62 |
| 7,846,431 B2 | 12/2010 | Bookbinder et al. | 424/94.62 |
| 7,871,607 B2 | 1/2011 | Bookbinder et al. | 424/94.62 |
| 7,977,361 B2 | 7/2011 | Collier et al. | 514/359 |
| 7,989,451 B2 | 8/2011 | Hay et al. | 514/218 |
| 8,023,714 B2 | 9/2011 | Soenksen | 382/132 |
| 8,034,630 B2 | 10/2011 | Terashima | 435/69.1 |
| 8,105,586 B2 | 1/2012 | Bookbinder et al. | 424/94.3 |
| 8,187,855 B2 | 5/2012 | Baker et al. | 435/201 |
| 8,202,517 B2 | 6/2012 | Bookbinder et al. | 424/94.62 |
| 8,257,699 B2 | 9/2012 | Bookbinder et al. | 424/94.62 |
| 8,343,487 B2 | 1/2013 | Baker et al. | 424/94.62 |
| 8,431,124 B2 | 4/2013 | Bookbinder et al. | 424/94.62 |
| 8,431,380 B2 | 4/2013 | Bookbinder et al. | 435/201 |
| 8,450,470 B2 | 5/2013 | Bookbinder et al. | 536/23.2 |
| 8,580,252 B2 | 11/2013 | Bookbinder et al. | 424/85.2 |
| 8,765,685 B2 | 7/2014 | Bookbinder et al. | 514/20.9 |
| 8,846,034 B2 * | 9/2014 | Jiang | A61K 38/47 424/94.62 |
| 2001/0021763 A1 | 9/2001 | Harris | 528/75 |
| 2001/0044526 A1 | 11/2001 | Shen | 530/409 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 530/402 |
| 2003/0220447 A1 | 11/2003 | Harris | 528/322 |
| 2004/0013637 A1 | 1/2004 | Bentley et al. | 424/78.17 |
| 2004/0235734 A1 | 11/2004 | Bossard | 514/12 |
| 2004/0268425 A1 | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0256188 A1 | 11/2005 | Denny et al. | 514/509 |
| 2005/0256191 A1 | 11/2005 | Denny et al. | 514/554 |
| 2005/0260186 A1 | 11/2005 | Bookbinder et al. | 424/94.62 |
| 2006/0024298 A1 | 2/2006 | Lazar et al. | 530/387.1 |
| 2006/0104968 A1 | 5/2006 | Bookbinder et al. | 424/94.62 |
| 2006/0205820 A1 | 9/2006 | Denny et al. | 514/644 |
| 2006/0223876 A1 | 10/2006 | Burd et al. | 514/418 |
| 2007/0027136 A1 | 2/2007 | Halbert et al. | 514/212.01 |
| 2007/0032455 A1 | 2/2007 | Denny et al. | 514/114 |
| 2007/0054916 A1 | 3/2007 | Patel et al. | 514/251 |
| 2007/0117784 A1 | 5/2007 | Cleland et al. | 514/183 |
| 2007/0161808 A1 | 7/2007 | Matthews et al. | 552/238 |
| 2007/0286856 A1 | 12/2007 | Brown et al. | 530/388.26 |
| 2008/0234276 A1 | 9/2008 | Boyle et al. | 435/184 |
| 2008/0306248 A1 | 12/2008 | Hu et al. | 530/400 |
| 2009/0030180 A1 | 1/2009 | Kolodka et al. | 514/2.6 |
| 2009/0123367 A1 | 5/2009 | Bookbinder et al. | 424/1.49 |
| 2009/0136521 A1 | 5/2009 | Parmar et al. | 424/173.1 |
| 2009/0186886 A1 | 7/2009 | Hay et al. | 514/232.8 |
| 2009/0253175 A1 | 10/2009 | Bookbinder et al. | 435/69.1 |
| 2010/0003238 A1 * | 1/2010 | Frost | A61K 31/337 424/94.62 |
| 2010/0136549 A1 | 6/2010 | Christiansen et al. | 702/19 |
| 2010/0143457 A1 | 6/2010 | Wei et al. | 424/450 |
| 2011/0111435 A1 | 5/2011 | Dobson et al. | 435/6 |
| 2011/0152359 A1 | 6/2011 | Bookbinder et al. | 435/200 |
| 2011/0288472 A1 | 11/2011 | Nuijen et al. | 514/414 |
| 2012/0020951 A1 * | 1/2012 | Shepard | A61K 31/37 424/130.1 |
| 2012/0148555 A1 | 6/2012 | Bookbinder et al. | 435/200 |
| 2012/0171153 A1 | 7/2012 | Frost et al. | 424/94.62 |
| 2012/0213767 A1 | 8/2012 | Wei et al. | 424/450 |
| 2012/0251620 A1 | 10/2012 | Bookbinder et al. | 424/450 |
| 2013/0011378 A1 | 1/2013 | Yang et al. | 424/94.3 |
| 2013/0022588 A1 | 1/2013 | Yang et al. | 424/94.3 |
| 2013/0022592 A1 | 1/2013 | Vaughn et al. | 424/94.62 |
| 2013/0058893 A1 | 3/2013 | Bookbinder et al. | 435/200 |
| 2013/0101577 A9 | 4/2013 | Wei et al. | |
| 2013/0202583 A1 * | 8/2013 | Jiang | A61K 38/47 424/94.62 |
| 2013/0251786 A1 | 9/2013 | Li et al. | 424/94.62 |
| 2013/0302275 A1 | 11/2013 | Wei et al. | 424/94.62 |
| 2013/0302400 A1 | 11/2013 | Maneval et al. | 435/195 |
| 2014/0037613 A1 | 2/2014 | Bookbinder et al. | 424/94.62 |
| 2014/0348817 A1 | 11/2014 | Jiang et al. | 424/94.62 |
| 2015/0218511 A1 | 8/2015 | Jiang et al. | 424/94.62 |

FOREIGN PATENT DOCUMENTS

| | | |
|---|---|---|
| EP | 0866709 | 9/1998 |
| EP | 0822199 | 9/2004 |
| EP | 1064951 | 8/2007 |
| GB | 975771 | 1/1964 |
| GB | 1087325 | 10/1967 |

(56) References Cited

FOREIGN PATENT DOCUMENTS

| | | |
|---|---|---|
| WO | WO 87/06227 | 10/1987 |
| WO | WO 88/02261 | 4/1988 |
| WO | WO 91/05824 | 5/1991 |
| WO | WO 93/10151 | 5/1993 |
| WO | WO 94/28024 | 12/1994 |
| WO | WO 97/20828 | 6/1997 |
| WO | WO 97/23456 | 7/1997 |
| WO | WO 98/39009 | 9/1998 |
| WO | WO 98/50431 | 11/1998 |
| WO | WO 99/45942 | 9/1999 |
| WO | WO 00/02017 | 1/2000 |
| WO | WO 00/64864 | 11/2000 |
| WO | WO 01/87925 | 4/2001 |
| WO | WO 01/76640 | 10/2001 |
| WO | WO 02/49673 | 6/2002 |
| WO | WO 2005/000360 | 1/2005 |
| WO | WO 2005/021533 | 3/2005 |
| WO | WO 2005/035548 | 4/2005 |
| WO | WO 2005/042471 | 5/2005 |
| WO | WO 2005/063816 | 7/2005 |
| WO | WO 2005/080314 | 9/2005 |
| WO | WO 2005/118799 | 12/2005 |
| WO | WO 2006/043839 | 4/2006 |
| WO | WO 2006/105507 | 10/2006 |
| WO | WO 2007/092963 | 8/2007 |
| WO | WO 2007/092964 | 8/2007 |
| WO | WO 2007/133725 | 11/2007 |
| WO | WO 2008/033040 | 3/2008 |
| WO | WO 2008/033041 | 3/2008 |
| WO | WO 2008/033440 | 3/2008 |
| WO | WO 2008/083101 | 7/2008 |
| WO | WO 2008/112934 | 9/2008 |
| WO | WO 2007/002931 | 4/2009 |
| WO | WO 2009/111066 | 9/2009 |
| WO | WO 2009/128917 | 10/2009 |
| WO | WO 2010/027280 | 3/2010 |
| WO | WO 2010/048330 | 4/2010 |
| WO | WO 2010/148138 | 12/2010 |
| WO | WO 2012/006032 | 1/2012 |
| WO | WO 2012/009288 | 1/2012 |
| WO | WO 2012/012300 | 1/2012 |
| WO | WO 2014/062856 | 4/2014 |

OTHER PUBLICATIONS

Jacobetz et al. (Gut. 2013. [available online Mar. 30, 2012]. 62: 112-120).*

Letter/Written Disclosure of the Supplemental Information Disclosure Statement for the above-referenced application, mailed Mar. 17, 2014, 2 pages.

Adams, G. and I. Stratford, "Bioreductive drugs for cancer therapy: the search for tumor specificity," Int. J. Radiat. Oncol. Biol. Phys., 29(2): 231-238 (1994).

Adams et al., "The c-myc oncogene driven by immunoglobulin enhancers induces lymphoid malignancy in transgenic mice," Nature 318:533-538 (1985).

Ahn et al., "Targeting tumors with hypoxia-activated cytotoxins," Frontiers in Bioscience 12:3483-3501 (2007).

Albertella et al., "Hypoxia-selective targeting by the bioreductive prodrug AQ4N in patients with solid tumors: results of a phase I study," Clin Cancer Res 14(4):1096-1104 (2008).

Alexander et al., "Expression of the c-myc oncogene under control of an immunoglobulin enhancer in E mu-myc transgenic mice," Mol. Cell Biol. 7:1436-1444 (1987).

Altschul, S., "Basic local alignment search tool," J Molec Biol 215(3):403-410 (1990).

Anderson et al., "Pulse radiolysis studies on the hypoxia-selective toxicity of a cobalt-mustard complex," Br J Cancer Suppl 27:S48-S51 (1996).

Ansel, H., Introduction to Pharmaceutical Dosage Forms, Fourth Edition, Lea & Febiger:Philadelphia, p. 126 (1985).

Arming et al., "In vitro mutagenesis of PH-20 hyaluronidase from human sperm," Eur J Biochem 247(3):810-814 (1997).

Ashkenazi et al.,"Protection against endotoxic shock by a tumor necrosis factor receptor immunoadhesin,"PNAS 88:10535-10539 (1991).

Auvinen, P. "Hyaluronan in peritumoral stroma and malignant cells associates with breast cancer spreading and predicts survival," American Journal of Pathology 156(2):529-536 (2000).

Begleiter et al., "Role of NADPH cytochrome P450 reductase in activation of RH1," Cancer Chemother Pharmacol., 60(5):713-723 (2007).

Belas et al., "Bacterial bioluminescence: isolation and expression of the luciferase genes from Vibrio harveyi," Science 218(4574):791-793 (1982).

Belcourt et al., "Differential toxicity of mitomycin C and porfiromycin to aerobic and hypoxic Chinese hamster ovary cells overexpressing human NADPH:cytochrome c (P-450) reductase," Proc Natl Acad Sci U S A. 93(1):456-460 (1996).

Bennewith, K. and S. Dedhar, "Targeting hypoxic tumour cells to overcome metastasis," BMC Cancer 11:504 (2011).

Bentzen et al., "Feasibility of detecting hypoxia in experimental mouse tumours with 18F-fluorinated tracers and positron emission tomography—a study evaluating [18F]Fluoro-2-deoxy-D-glucose," Acta. Oncol. 39(5):629-637 (2000).

Blundell et al., "Determining the molecular basis for the pH-dependent interaction between the link module of human TSG-6 and hyaluronan," J Biol Chem 282(17):12976-12988 (2007).

Blundell et al., "The link module from ovulation- and inflammation-associated protein TSG-6 changes conformation on hyaluronan binding," J Biol Chem 278(49):49261-49270 (2003).

Blundell et al., "Towards a structure for a TSG-6.hyaluronan complex by modeling and NMR spectroscopy: insights into other members of the link module superfamily," J Biol Chem 280(18):18189-18201 (2005).

Boger, D. and D. Johnson, "CC-1065 and the duocarmycins: unraveling the keys to a new class of naturally derived DNA alkylating agents," Proc. Natl. Acad. Sci. U.S.A. 92(9):3642-3649 (1995).

Borch et al., "Synthesis and evaluation of nitroheterocyclic phosphoramidates as hypoxia-selective alkylating agents," J. Med. Chem. 43:2258-2265 (2000).

Bordier C., "Phase separation of integral membrane proteins in Triton X-114 solution," J Biol Chem. 256(4):1604-1607 (1981).

Brinster et al., "Regulation of metallothionein—thymidine kinase fusion plasmids injected into mouse eggs," Nature 296:39-42 (1982).

Brizel et al., "Tumor oxygenation predicts for the likelihood of distant metastases in human soft tissue sarcoma," Cancer Res. 56(5): 941-943 (1996).

Brown J., "Exploiting the hypoxic cancer cell: mechanisms and therapeutic strategies," Mol Med Today, 6: 157-162 (2000).

Brown, J., "SR 4233 (tirapazamine): a new anticancer drug exploiting hypoxia in solid tumours," Br J Cancer 67(6):1163-1170 (1993).

Brown, J., "The hypoxic cell: a target for selective cancer therapy—eighteenth Bruce F. Cain Memorial Award lecture," Cancer Res. 59 (23):5863-5870 (1999).

Busch, S. and P. Sassone-Corsi, "Dimers, leucine zippers and DNA-binding domains," Trends Genetics, 6:36-40 (1990).

Byrn et al., "Biological properties of a CD4 immunoadhesin," Nature 344:(6267)667-670 (1990).

Camenisch et al., "Disruption of hyaluronan synthase-2 abrogates normal cardiac morphogenesis and hyaluronan-mediated transformation of epithelium to mesenchyme," J Clin Invest., 106:349-360 (2000).

Camp et al., "Automated subcellular localization and quantification of protein expression in tissue microarrays," Nature Medicine, 8(11):1323-1327 (2002).

Carlsson et al., "Protein thiolation and reversible protein-protein conjugation. N-Succinimidyl 3-(2-pyridyldithio)propionate, a new heterobifunctional reagent," Biochem. J. 173(3):723-737 (1978).

Carrillo, H. and D. Lipman, "The multiple-sequence alignment problem in biology," SIAM J Applied Math 48:1073-1082 (1988).

Chao, H and A. Spicer, "Natural antisense mRNAs to hyaluronan synthase 2 inhibit hyaluronan biosynthesis and cell proliferation," J. Biol. Chem. 280(30):27513-27522 (2005).

(56) References Cited

OTHER PUBLICATIONS

Chao et al., "A novel approach to overcome hypoxic tumor resistance: Cu-ATSM-guided intensity-modulated radiation therapy," Int. J. Radiat. Oncol. Biol. Phys. 49(4):1171-1182 (2001).
Chapman et al., "Therapeutic antibody fragments with prolonged in vivo half-lives," Nature Biotech. 17:780-783 (1999).
Chenevert et al., "Monitoring early response of experimental brain tumors to therapy using diffusion magnetic resonance imaging," Clin Cancer Res. 3(9):1457-1466 (1997).
Cherr et al., "The dual functions of GPI-anchored PH-20: hyaluronidase and intracellular signaling," Matrix Biol., 20(8):515-525 (2001).
Cumber et al., "Structural features of the antibody-A chain linkage that influence the activity and stability of ricin A chain immunotoxins," Bioconj. Chem. 3(5):397-401 (1992).
Danilkovitch-Miagkova et al., "Hyaluronidase 2 negatively regulates RON receptor tyrosine kinase and mediates transformation of epithelial cells by jaagsiekte sheep retrovirus," Proc Natl Acad Sci US A. 100(8):4580-4585 (2003).
de Kruif, J. and T. Logtenberg, "Leucine zipper dimerized bivalent and bispecific scFv antibodies from a semi-synthetic antibody phage display library," J. Biol. Chem. 271(13):7630-7634 (1996).
De Maeyer et al., "The growth rate of two transplantable murine tumors, 3LL lung carcinoma and B16F10 melanoma, is influenced by Hyal-1, a locus determining hyaluronidase levels and polymorphism," Int. J. Cancer 51:657-660 (1992).
de Wet et al., "Firefly luciferase gene: structure and expression in mammalian cells," Mol. Cell. Biol. 7(2):725-737 (1987).
DeBoer et al., "The tac promoter: a functional hybrid derived from the trp and lac promoters," Proc. Natl. Acad. Sci. USA 80:21-25 (1983).
Dehdashti et al., "In vivo assessment of tumor hypoxia in lung cancer with 60Cu-ATSM," Eur J Nucl Med Mol Imaging, 30(6):844-850 (2003).
Delpech et al., "Enzyme-linked hyaluronectin: a unique reagent for hyaluronan assay and tissue location and for hyaluronidase activity detection," Anal. Biochem. 229:35-41 (1995).
Devereux et al., "A comprehensive set of sequence analysis programs for the VAX," Nucleic Acids Research 12:387-395 (1984).
Deyev et al., "Design of multivalent complexes using the barnase*barstar module," Nat. Biotechnol. 2(12):1486-1492 (2003).
Duan et al., "Potent and highly selective hypoxia-activated achiral phosphoramidate mustards as anticancer drugs," J. Med. Chem. 51(8):2412-2420 (2008).
Dubois et al., "[18F]EF3 is not superior to [18F]FMISO for PET-based hypoxia evaluation as measured in a rat rhabdomyosarcoma tumour model," Eur J Nucl Med Mol Imaging, 36:209-218 (2009).
Dubois et al., "Preclinical evaluation and validation of [18F]HX4, a promising hypoxia marker for PET imaging," Proc Natl Acad Sci USA. 108(35):14620-14625 (2011).
Edward et al., "4-Methylumbelliferone inhibits tumour cell growth and the activation of stromal hyaluronan synthesis by melanoma cell-derived factors," Br. J. Dermatol. 162(6):1224-1232 (2010).
Ellison et al., "The nucleotide sequence of a human immunoglobulin C gamma1 gene," Nucleic Acids Research, 10(13):4071-4079 (1982).
Ernst et al., "Enzymatic degradation of glycosaminoglycans," Crit Rev Biochem Mol Biol. 30(5):387-444 (1995).
Escher et al., "Bacterial luciferase alpha beta fusion protein is fully active as a monomer and highly sensitive in vivo to elevated temperature," Proc Natl Acad Sci USA., 86(17):6528-6532 (1989).
Evans, S. and C. Koch, "Prognostic significance of tumor oxygenation in humans," Cancer Lett. 195(1):1-16 (2003).
Evans et al., "Homologous recombination is the principal pathway for the repair of DNA damage induced by tirapazamine in mammalian cells," Cancer Res. 68(1):257-265 (2008).
Everett et al., "Modifying rates of reductive elimination of leaving groups from indolequinone prodrugs: a key factor in controlling hypoxia-selective drug release," Biochem. Pharmacol. 63(9):1629-1639 (2002).
Fadnes et al., "Interstitial fluid pressure in rats measured with a modified wick technique," Microvasc. Res. 14(1):27-36 (1977).
Fattom et al., "Comparative immunogenicity of conjugates composed of the Staphylococcus aureus type 8 capsular polysaccharide bound to carrier proteins by adipic acid dihydrazide or N-succinimidyl-3-(2-pyridyldithio)propionate," Infect Immun. 60(2):584-589 (1992).
Ferrara, N. "The role of vascular endothelial growth factor in pathological angiogenesis," Breast Cancer Res Treat, 36(2):127-137 (1995).
Foran, D. and W. Brown, "Nucleotide sequence of the LuxA and LuxB genes of the bioluminescent marine bacterium Vibrio fischeri," Nucleic Acids Res. 16(2):777 (1988).
Fracasso, P. and A. Sartorelli, "Cytotoxicity and DNA lesions produced by mitomycin C and porfiromycin in hypoxic and aerobic EMT6 and Chinese hamster ovary cells," Cancer Res 46(8):3939-3944 (1986).
Frost et al., "Purification, cloning, and expression of human plasma hyaluronidase," Biochem. Biophys. Res. Commun. 236(1):10-15 (1997).
Frost, G. and R. Stern, "A microtiter-based assay for hyaluronidase activity not requiring specialized reagents," Anal. Biochem. 251:263-269 (1997).
Frost, G., "Recombinant human hyaluronidase (rHuPH20): an enabling platform for subcutaneous drug and fluid administration," Expert Opin. Drug. Deliv. 4:427-440 (2007).
Fujibayashi et al., "Copper-62-ATSM: a new hypoxia imaging agent with high membrane permeability and low redox potential," J. Nucl. Med. 38(7):1155-1160 (1997).
Gardner et al., "The complete nucleotide sequence of an infectious clone of cauliflower mosaic virus by M13mp7 shotgun sequencing," Nucleic Acids Res. 9:2871-2888 (1981).
Gentz et al., "Parallel association of Fos and Jun leucine zippers juxtaposes DNA binding domains," Science, 243(4899):1695-1699 (1989).
Gilbert, W. and L. Villa-Komaroff, "Useful proteins from recombinant bacteria," Scientific American 242(4):74-94 (1980).
Gordon et al., "Topographical localization of the C-terminal region of the voltage-dependent sodium channel from Electrophorus electricus using antibodies raised against a synthetic peptide," Proc. Natl. Acad Sci. 84(1):308-312 (1987).
Gribskov, M. and R. Burgess, "Sigma factors from E. coli, B. subtilis, phage SP01, and phage T4 are homologous proteins," Nucl. Acids Res. 14(16):6745-6763 (1986).
Gronroos et al., "Pharmacokinetics of [18F]FETNIM: a potential marker for PET," J. Nucl. Med., 42(9):1397-1404 (2001).
Grosschedl et al., "Introduction of a mu immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12:177-180 (2002).
Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).
Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature 315(6015):115-122 (1985).
Harris, A., "Hypoxia—a key regulatory factor in tumour growth," Nat Rev Cancer. 2(1): 38-47 (2002).
Harris, J. and R. Chess, "Effect of pegylation on pharmaceuticals," Nat Rev Drug Discov 2(3):214-221 (2003).
Haserodt et al., "A comparison of the sensitivity, specificity, and molecular weight accuracy of three different commercially available Hyaluronan ELISA-like assays," Glycobiology 21(2):175-183 (2011).
Helsby et al., "Effect of nitroreduction on the alkylating reactivity and cytotoxicity of the 2,4-dinitrobenzamide-5-aziridine CB 1954

(56) References Cited

OTHER PUBLICATIONS and the corresponding nitrogen mustard SN 23862: distinct mechanisms of bioreductive activation," Chem. Res. Toxicol. 16(4):469-478 (2003).
Hendricksen et al., "Safety and side effects of immediate instillation of apaziquone following transurethral resection in patients with nonmuscle invasive bladder cancer," J. Urol. 180(1):116-120.
Herrera-Estrella et al., "Expression of chimaeric genes transferred into plant cells using a ti-plasmid-derived vector," Nature 303:209-213 (1983).
Herrera-Estrella et al., "Light-inducible and chloroplast-associated expression of a chimaeric gene introduced into *Nicotiana tabacum* using a Ti a lasmid vector," Nature 310(5973):115-120 (1984).
Hibi et al., "Chondroitinase C activity of *Streptococcus intermedius*," FEMS-Microbiol-Lett. 48(2):121-124 (1989).
Hicks et al., "Pharmacokinetic/pharmacodynamic modeling identifies SN30000 and SN29751 as tirapazamine analogues with improved tissue penetration and hypoxic cell killing in tumors," Clin. Cancer Res. 16(20):4946-4957 (2010).
Höckel et al., "Intratumoral pO2 predicts survival in advanced cancer of the uterine cervix," Radiother. Oncol. 26(1):45-50 (1993).
Höckel et al., "Association between tumor hypoxia and malignant progression in advanced cancer of the uterine cervix," Cancer Res., 56(19):4509-4515 (1996).
Hollenbaugh, D. and A. Aruffo, "Construction of Immunoglobulin Fusion Proteins," in Current Protocols in Immunology, Chapter 10:Unit 10.19A, 11 pages (2002).
Hovingh, P. and A. Linker, "Hyaluronidase activity in leeches (*Hirudinea*)," Comp Biochem Physiol B Biochem Mol Biol. 124(3):319-326 (1999).
Hunter et al., "Homologous recombination repair-dependent cytotoxicity of the benzotriazine di-N-oxide CEN-209: comparison with other hypoxia-activated prodrugs," Biochem Pharmacol. 83(5):574-585 (2012).
Huston et al., "Protein engineering of antibody binding sites: recovery of specific activity in an anti-digoxin single-chain Fv analogue produced in *Escherichia coli*," Proc. Natl. Acad. Sci. U.S.A. 85(16):5879-5883 (1988).
Itano et al., "Impact of the hyaluronan-rich tumor microenvironment on cancer initiation and progression," Cancer Sci 99(9):1720-1725 (2008).
IUPAC-IUB, "Abbreviated nomenclature of synthetic polypeptides-polymerized amino acids-revised recommendations," Commission on Biochemical Nomenclature, Biochemistry 11:1726-1731 (1972).
Jay et al., "Construction of a general vector for efficient expression of mammalian proteins in bacteria: use of a synthetic ribosome binding site," Proc. Natl. Acad. Sci. USA 78:5543-5548 (1981).
Kahmann et al., "Localization and characterization of the hyaluronan-binding site on the link module from human TSG-6," Structure 8(7):763-774 (2000).
Karlgren et al., "Tumor-specific expression of the novel cytochrome P450 enzyme, CYP2W1," Biochem Biophys Res Commun 341(2):451-458 (2006).
Karvinen et al., "Hyaluronan, CD44 and versican in epidermal keratinocyte tumors," British Journal of Dermatology 148:86-94 (2003).
Kelsey et al., "Species- and tissue-specific expression of human alpha 1-antitrypsin in transgenic mice," Genes and Devel. 1:161-171 (1987).
Keyes et al., "Porfiromycin as a bioreductive alkylating agent with selective toxicity to hypoxic EMT6 tumor cells in vivo and in vitro," Cancer Res. 45(8):3642-3645 (1985).
Knox et al., "CB 1954: from the Walker tumor to NQO2 and VDEPT," Curr. Pharm. Des. 9(26):2091-2104 (2003).
Koch, C., "Importance of antibody concentration in the assessment of cellular hypoxia by flow cytometry: EF5 and pimonidazole," Radiat Res. 169(6):677-688 (2008).
Kohda et al., "Solution structure of the link module: a hyaluronan-binding domain involved in extracellular matrix stability and cell migration," Cell 86(5):767-775 (1996).

Kollias et al., "Regulated expression of human A gamma-, beta-, and hybrid gamma beta-globin genes in transgenic mice: manipulation of the developmental expression patterns," Cell 46:89-94 (1986).
Komar et al., "18F-EF5: a new PET tracer for imaging hypoxia in head and neck cancer," J Nucl Med. 49(12):1944-1951 (2008).
Krumlauf et al., Developmental regulation of alpha-fetoprotein genes in transgenic mice, Mol. Cell. Biol. 5:1639-1648 (1985).
Lalancette et al, "Characterization of an 80-kilodalton bull sperm protein identified as PH-20," Biol Reprod. 65(2):628-636 (2001).
Leder et al., "Consequences of widespread deregulation of the c-myc gene in transgenic mice: multiple neoplasms and normal development," Cell 45:485-495 (1986).
Lee et al., "A novel secretory tumor necrosis factor-inducible protein (TSG-6) is a member of the family of hyaluronate binding proteins, closely related to the adhesion receptor CD44," J Cell Biol 116(2):545-557 (1992).
Lennon et al., "Cultivation of rat marrow-derived mesenchymal stem cells in reduced oxygen tension: effects on in vitro and in vivo osteochondrogenesis," J. Cell Physiol. 187(3):345-355 (2001).
Lesley et al., "Hyaluronan binding properties of a CD44 chimera containing the link module of TSG-6" J Biol Chem 277(29):26600-26608 (2002).
Lesley et al., "TSG-6 modulates the interaction between hyaluronan and cell surface CD44," J Biol Chem 279(24):25745-25754 (2004).
Li et al., "Direct labeling and visualization of blood vessels with lipophilic carbocyanine dye DiI," Nat. Protoc. 3(11):1703-1708 (2008).
Lipponen et al., "High stromal hyaluronan level is associated with poor differentiation and metastasis in prostate cancer," Euro J Can. 37:849-856 (2001).
Loadman et al., "Pharmacological approach towards the development of indolequinone bioreductive drugs based on the clinically inactive agent EO9," Br J Pharmacol. 137(5):701-709 (2002).
Lokeshwar et al., "Antitumor activity of hyaluronic acid synthesis inhibitor 4-methylumbelliferone in prostate cancer cells," Cancer Res 70(7):2613-2623 (2010).
Lokeshwar et al., "Urinary hyaluronic acid and hyaluronidase: markers for bladder cancer detection and evaluation of grade," J. Urol. 163(1):348-356 (2000).
Lorenz et al., "Isolation and expression of a cDNA encoding Renilla reniformis luciferase," Proc Natl Acad Sci USA 88(10):4438-4442 (1991).
Lu , X. and Y. Kang, Hypoxia and hypoxia-inducible factors: master regulators of metastasis, Clin Cancer Res. 16(24):5928-5935 (2010).
Lucignani, G., "PET imaging with hypoxia tracers: a must in radiation therapy," Eur J Nucl Med Mol Imaging. 35(4):838-842 (2008) and Erratum Lucignani, G., Eur J Nucl Med Mol Imaging, 35:1033 (2008).
MacDonald, R., "Expression of the pancreatic elastase I gene in transgenic mice," Hepatology 7:42S-51S(1987).
Magram et al., "Developmental regulation of a cloned adult beta-globin gene in transgenic mice," Nature 315:338-340 (1985).
Mahan et al., "Phase change enzyme immunoassay," Anal. Biochem., 162(1):163-170 (1987).
Mahoney et al., "Characterization of the interaction between tumor necrosis factor-stimulated gene-6 and heparin: implications for the inhibition of plasmin in extracellular matrix microenvironments," Journal of Biological Chemistry, 280(29):27044-27055 (2005).
Mahoney et al., "Mapping the hyaluronan-binding site on the link module from human tumor necrosis factor-stimulated gene-6 by site-directed mutagenesis," J Biol Chem 276(25):22764-22771 (2001).
Malkinson et al., "Elevated DT-diaphorase activity and messenger RNA content in human non-small cell lung carcinoma: relationship to the response of lung tumor xenografts to mitomycin Cł," Cancer Res.52(17):4752-4757 (1992).
Marcu, L. and I. Olver, "Tirapazamine: from bench to clinical trials," Curr Clin Pharmacol. 1(1):71-79 (2006).
Mason et al., "The hypogonadal mouse: reproductive functions restored by gene therapy," Science 234:1372-1378 (1986).

(56) References Cited

OTHER PUBLICATIONS

McLachlan, A. and M. Stewart, "Tropomyosin coiled-coil interactions: evidence for an unstaggered structure," J. Mol. Biol. 98(2):293-304 (1978).
Mehvar, R., "Modulation of the pharmacokinetics and pharmacodynamics of proteins by polyethylene glycol conjugation," J. Pharm. Pharmaceut. Sci. 3(1):125-136 (2000).
Michelacci, Y. and C. Dietrich, "Chondroitinase C from Flavobacterium heparinum," J. Biol. Chem. 251:1154-1158 (1976).
Milner, C. and A. Day, "TSG-6: a multifunctional protein associated with inflammation," J Cell Sci, 116(Pt.10):1863-1873 (2003).
Molina et al., "Global proteomic profiling of phosphopeptides using electron transfer dissociation tandem mass spectrometry," Proc Natl Acad Sci USA 104(7):2199-2204 (2007).
Monfardini et al., "A branched monomethoxypoly(ethylene glycol) for protein modification," Bioconjugate Chem. 6:62-69 (1995).
Moody et al., "Cyclopropamitosenes: novel bioreductive anticancer agents—mechanism of action and enzymic reduction," Anticancer Drugs. 5(3):367-372 (1994).
Morohashi et al., "Study of hyaluronan synthase inhibitor, 4-methylumbelliferone derivatives on human pancreatic cancer cell (KP1-NL)," Biochem Biophys Res Commun. 345(4):1454-1459 (2006).
Morrison et al., "Culture in reduced levels of oxygen promotes clonogenic sympathoadrenal differentiation by isolated neural crest stem cells," J Neurosci., 20(19):7370-7376 (2000).
Müller et al., "The first constant domain (C(H)1 and C(L)) of an antibody used as heterodimerization domain for bispecific miniantibodies," FEBS Lett. 422(2):259-264 (1998).
Nakazawa et al., "4-methylumbelliferone, a hyaluronan synthase suppressor, enhances the anticancer activity of gemcitabine in human pancreatic cancer cells," Cancer Chemother Pharmacol 57(2):165-170 (2006).
Needleman, S. and C. Wunsch "A general method applicable to the search for similarities in the amino acid sequence of two proteins," J Mol Biol. 48:443-453 (1970).
Nentwich et al., "A novel allelic variant of the human TSG-6 gene encoding an amino acid difference in the CUB module. Chromosomal localization, frequency analysis, modeling, and expression," J Biol Chem 277:15354-15362 (2002).
Newton et al., "Angiogenin single-chain immunofusions: influence of peptide linkers and spacers between fusion protein domains," Biochemistry 35(2):545-553 (1996).
Nishida et al., "Antisense inhibition of hyaluronan synthase-2 in human articular chondrocytes inhibits proteoglycan retention and matrix assembly," J. Biol. Chem. 274(31):21893-21899 (1999).
Nishida et al., "Efficient hypoxic activation of the anticancer agent AQ4N by CYP2S1 and CYP2W1," Mol. Pharmacol. 78(3):497-502 (2010).
Nogrady, T., *Medicinal Chemistry A Biochemical Approach*, 30 Oxford University Press, New York, pp. 388-392 (1985).
Nordsmark, M. and J. Overgaard, "A confirmatory prognostic study on oxygenation status and loco-regional control in advanced head and neck squamous cell carcinoma treated by radiation therapy," Radiother. Oncol. 57(1):39-43 (2000).
O'Shea et al., "Preferential heterodimer formation by isolated leucine zippers from fos and jun," Science, 245(4918):646 (1989).
Ohya, T., and Y. Kaneko, "Novel hyaluronidase from streptomyces," Biochim. Biophys. Acta 198:607-609 (1970).
Olive, P. and C. Aquino-Parsons, "Measurement of tumor hypoxia using single-cell methods," Semin Radiat Oncol. 14(3):241-248 (2004).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Ozerdem, U. and A. Hargens, "A simple method for measuring interstitial fluid pressure in cancer tissues," Microvasc. Res. 70:116-120 (2005).
Palmer et al. "Hypoxia-selective antitumor agents. 5. Synthesis of water-soluble nitroaniline mustards with selective cytotoxicity for hypoxic mammalian cells," J. Med. Chem. 35(17):3214-22 (1992).
Papadopoulou, M. and W. Bloomer, NLCQ-1 (NSC 709257): exploiting hypoxia with a weak DNA-intercalating bioreductive drug, Clin. Cancer Res. 9(15):5714-5720 (2003).
Papadopoulou et al., "4-[3-(2-Nitro-l-imidazolyl)propylamino]-7-chloroquinoline hydrochloride (NLCQ-1), a novel bioreductive compound as a hypoxia-selective cytotoxin," Oncol. Res. 12(4):185-192 (2000).
Parmar et al., "Distribution of hematopoietic stem cells in the bone marrow according to regional hypoxia," Proc Natl Acad Sci U S A. 104(13):5431-5436 (2007).
Patterson, L. and S. McKeown, "AQ4N: a new approach to hypoxia-activated cancer chemotherapy," Br. J. Cancer 83(12):1589-1593 (2000).
Patterson et al., "Enhancement of chemotherapy and radiotherapy of murine tumours by AQ4N, a bioreductivel activated anti-tumour went," Br. J. Cancer 82(12):1984-1990 (2000).
Patterson et al., "Mechanism of action and preclinical antitumor activity of the novel hypoxia-activated DNA cross-linking agent PR-104," Clin. Cancer Research. 13(13):3922-3932 (2007).
Patterson, L., "Bioreductively activated antitumor N-oxides: the case of AQ4N, a unique approach to hypoxia-activated cancer chemotherapy," Drug Metab. Rev. 34(3): 581-592 (2002).
Patterson, L., "Rationale for the use of aliphatic N-oxides of cytotoxic anthraquinones as prodrug DNA binding agents: a new class of bioreductive agent," Cancer Metastasis Rev. 12(2):119-134 (1993).
Pawlowski et al., "The effects of hyaluronidase upon tumor formation in BALB/c mice painted with 7,12-dimethylbenz-(a)anthracene," Int. J. Cancer 23:105-109 (1979).
Pearson, W. and D. Lipman "Improved tools for biological sequence comparison," Proc. Natl. Acad. Sci. USA 85:2444 (1988).
Pham et al., "Large-scale transient transfection of serum-free suspension-growing HEK293 EBNA1 cells: peptone additives improve cell growth and transfection efficiency," Biotechnology and Bioengineering 84:332-342 (2003).
Pinkert et al., "An albumin enhancer located 10 kb upstream functions along with its promoter to direct efficient, liver-specific expression in transgenic mice," Genes and Devel. 1:268-276 (1987).
Pirinen et al "Prognostic value of hyaluronan expression in non-small cell lung cancer: Increased stromal expression indicated unfavorable outcome in patients with adenocarcinoma" Int. J. Cancer 95:12-17 (2001).
Plumb et al., "DT-diaphorase protects cells from the hypoxic cytotoxicity of indoloquinone EO9," Br. J. Cancer., 70(6):1136-1143 (1994).
Prasher et al., "Primary structure of the Aequorea victoria green-fluorescent protein," Gene 111(2):229-233 (1987).
Prasher et al., "Sequence comparisons of complementary DNAs encoding aequorin isotypes," Biochem. 26(5):1326-1332 (1987).
Raleigh et al., "Involvement of human cytochromes P450 (CYP) in the reductive metabolism of AQ4N, a hypoxia activated anthraquinone di-N-oxide prodrug," Int J Radiat Oncol Biol Phys 42(4):763-767 (1998).
Raleigh et al., "Rat cytochromes P450 (CYP) specifically contribute to the reductive bioactivation of AQ4N, an alkylaminoanthraquinone-di-N-oxide anticancer prodrug," Xenobiotica 29(11):1115-1122 (1999).
Rasey et al., Determining hypoxic fraction in a rat glioma by uptake of radiolabeled fluoromisonidazole. Radiat. Res. 153(1): 84-92 (2000).
Readhead et al., "Expression of a myelin basic protein gene in transgenic shiverer mice: correction of the dysmyelinating phenotype," Cell 48:703-712 (1987).
Ridgway et al., "'Knobs-into-holes' engineering of antibody CH3 domains for heavy chain heterodimerization," Protein Engineering, 9(7):617-621 (1996).
Roberts et al., "Chemistry for peptide and protein PEGylation," Advanced Drug Delivery Review 54:459-476 (2002).

(56) References Cited

OTHER PUBLICATIONS

Ropponen et al "Tumor cell-associated hyaluronan as an unfavorable prognostic factor in colorectal cancer," Cancer Research 58:342-347 (1998).
Sato et al., "Cloning and expression in *Escherichia coli* of the gene encoding the Proteus vulgaris chondroitin ABC lyase," Appl. Microbiol. Biotechnol. 41(1):39-46 (1994).
Sato, H., "Enzymatic procedure for site-specific pegylation of proteins," Adv. Drug Deliv. Rev. 54:487-504 (2002).
Schmiedl et al., "Expression of a bispecific dsFv-dsFv' antibody fragment in *Escherichia coli*," Protein Eng. 13:725-734 (2000).
Schwartz, R. and M. Dayhoff, eds., *Atlas of Protein Sequence and Structure*, National Biomedical Research Foundation, pp. 353-358 (1979).
Serganova et al., "Tumor hypoxia imaging," Clin Cancer Res, 12:5260-5264 (2006).
Shani, M., "Tissue-specific expression of rat myosin light-chain," Nature 314:283-286 (1985).
Siim et al., "Nitro reduction as an electronic switch for bioreductive drug activation," Oncol. Res. 9(6-7):357-369 (1997).
Simpson et al., "Inhibition of prostate tumor cell hyaluronan synthesis impairs subcutaneous growth and vascularization in immunocompromised mice," Am J Pathol 161(3):849-857 (2002).
Simpson et al., "Manipulation of hyaluronan synthase expression in prostate adenocarcinoma cells alters pericellular matrix retention and adhesion to bone marrow endothelial cells," J. Biol. Chem. 277(12):10050-10057 (2002).
Skarsgard et al., "Cytotoxic effect of RB 6145 in human tumour cell lines: dependence on hypoxia, extra- and intracellular pH and drug uptake," Br. J. Cancer. 72(6):1479-1486 (1995).
Smaill et al., "Abstract C46: Design and identification of the novel hypoxia-activated irreversible pan-HER inhibitor SN29966," Mol. Cancer Ther. 8(12 Suppl):C46 (2009).
Smith, T. and M. Waterman, "Comparison of biosequences," Advances in Applied Mathematics 2:482-489 (1981).
Stuhlmeier, KM, "Effects of leflunomide on hyaluronan synthases (HAS): NF-kappa B-independent suppression of IL-1-induced HAS1 transcription by leflunomide," J Immunol 174(11):7376-7382 (2005).
Swift et al., "Tissue-specific expression of the rat pancreatic elastase I gene in transgenic mice," Cell 38(3):639-646 (1984).
Takahashi et al., "A fluorimetric Morgan-Elson assay method for hyaluronidase activity," Anal. Biochem., 322:257-263 (2003).
Tercel et al., "Hypoxia-selective antitumor agents. 16. Nitroarylmethyl quaternary salts as bioreductive prodrugs of the alkylating agent mechlorethamine," J. Med. Chem. 44(21):3511-3522 (2001).
Tercel et al., "Selective treatment of hypoxic tumor cells in vivo: phosphate pre-prodrugs of nitro analogues of the duocarmycins," Anew Chem Int Ed Engl. 50(11):2606-2609 (2011).
Terskikh et al., 'Peptabody': a new type of high avidity binding proteinm Proc Natl Acad Sci USA 94(5):1663-1668 (1997).
Thompson et al., "Enzymatic depletion of tumor hyaluronan induces antitumor responses in preclinical animal models," Molecular Cancer Therapeutics, 9(11):3052-3064 (2010).
Thorpe et al., "New coupling agents for the synthesis of immunotoxins containing a hindered disulfide bond with improved stability in vivo," Cancer Res., 47(22):5924-5931 (1987).
Tkalec et al., "Isolation and expression in *Escherichia coli* of cslA and cs1B, genes coding for the chondroitin sulfate-degrading enzymes chondroitinase AC and chondroitinase B, respectively, from Flavobacterium heparinum," Applied and Environmental Microbiology 66(1):29-35 (2000).
Tsubery et al., "Prolonging the action of protein and peptide drugs by a novel approach of reversible polyethylene glycol modification," J Biol. Chem 279(37):38118-38124 (2004).
Tsuda et al., "Substrate specificity studies of flavobacterium chondroitinase C and heparitinases towards the glycosaminoglycan—protein linkage region. Use of a sensitive analytical method developed by chromophore-labeling of linkage glycoserines using dimethylaminoazobenzenesulfonyl chloride," Eur. J. Biochem. 262:127-133 (1999).
Turner, R. and R. Tijian,"Leucine repeats and an adjacent DNA binding domain mediate the formation of functional cFos-cJun heterodimers," Science, 243(4899):1689-1694 (1989).
Udabage L., "Antisense-mediated suppression of hyaluronan synthase 2 inhibits the tumorigenesis and progression of breast cancer" Cancer Res. 65(14):6139-6150 (2005).
Van De Wiele et al., "Imaging tumour hypoxia: where are we?" Nucl Med Commun, 22(9):945-947 (2001).
Veronese et al., "Branched and linear poly(ethylene glycol): influence of the polymer structure on enzymological, pharmacokinetic, and immunological properties of protein conjugates," J. Bioactive Compatible Polymers 12:196-207 (1997).
Wagner et al., "Nucleotide sequence of the thymidine kinase gene of herpes simplex virus type 1," Proc. Natl. Acad. Sci. USA 78:1441-1445 (1981).
Walden et al., "Major histocompatibility complex-restricted and unrestricted activation of helper T cell lines by liposome-bound antigens," J. Mol. Cell Immunol. 2(4):191-197 (1986).
Walton et al., "Molecular enzymology of the reductive bioactivation of hypoxic cell cytotoxins," Int. J. Radiat. Oncol. Biol. Phys. 16:(4)983-986 (1989).
Ward et al., "Preclinical evaluation of the pharmacodynamic properties of 2,5-diaziridinyl-3-hydroxymethyl-6-methyl-1,4-benzoquinone," Clin Cancer Res, 11(7):2695-2701 (2005).
Watson et al., *Molecular Biology of the Gene*, 4th Edition, The Benjamin/Cummings Pub. Co., p. 224 (1987).
Wawrzynczak et al., "Molecular and biological properties of an abrin A chain immunotoxin designed for therapy of human small cell lung cancer," Br. J. Cancer 66(2):361-366 (1992).
Weidner et al., "Tumor angiogenesis and metastasis—correlation in invasive breast carcinoma," N Engl J Med, 324(1):1-8 (1991).
Whitlow et al., "An improved linker for single-chain Fv with reduced aggregation and enhanced proteolytic stability," Protein Engineering 6(8):989-995 (1993).
Wilson et al., "Exploiting tumor hypoxia through bioreductive release of diffusible cytotoxins: the cobalt(III)-nitrogen mustard complex SN 24771," Int J Radiat Oncol Biol Phys 29(2):323-327 (1994).
Wilson, W. and M. Hay, "Targeting hypoxia in cancer therapy," Nat Rev Cancer. 11(6):393-410 (2011).
Winski et al., "A new screening system for NAD(P)H:quinone oxidoreductase (NQO1)-directed antitumor quinones: identification of a new aziridinylbenzoquinone, RH1, as a NQO1-directed antitumor agent," Clinical Cancer Res. 4(12):3083-3088 (1998).
Yamagata et al., "Purification and properties of bacterial chondroitinases and chondrosulfatases," J. Biol. Chem. 243: 1523-1535 (1968).
Yamamoto et al., "Identification of a functional promoter in the long terminal repeat of Rous sarcoma virus," Cell 22:787-797 (1980).
Yang et al. "Development of F-18-labeled fluoroerythronitroimidazole as a PET agent for imaging tumor hypoxia," Radiology 194(3):795-800 (1995).
Yang et al., "Purification and characterization of heparinase from Flavobacterium heparinum," J. Biol. Chem. 160(30):1849-1857 (1985).
Yoshihara et al., "A hyaluronan synthase suppressor, 4-methylumbelliferone, inhibits liver metastasis of melanoma cells," FEBS Lett 579(12):2722-2726 (2005).
Letter/Written Disclosure of the Supplemental Information Disclosure Statement for the above-referenced application, mailed Mar. 28, 2014, 2 pages.
Al'Qteishat et al., "Changes in hyaluronan production and metabolism following ischaemic stroke in man," Brain., 129(Pt 8):2158-2176 (2006).
Baranova et al., "The inflammation-associated protein TSG-6 cross-links hyaluronan via hyaluronan-induced TSG-6 oligomers," J Biol Chem., 286(29):25675-25686 (2011).
ClinicalTrials.gov, "Safety study of PEGPH20 given to patients with advanced solid tumors," ClinicalTrials.gov identifier: NCT00834704; study first received: Jan. 29, 2009; last updated: Sep. 10, 2012. [retrieved on Feb. 15, 2013] Retrieved from the

(56) References Cited

OTHER PUBLICATIONS

Internet<URL:clinicaltrials.gov/ct2/show/NCT00834704?term=PEGPH20&rank=1, 3 pages.
Dahl et al. "A longitudinal study of the hyaluronan level in the serum of patients with malignant mesothelioma under treatment. Hyaluronan as an indicator of progressive disease," Cancer 64(1):68-73 (1989).
Delpech et al., "Immunoenzymoassay of the hyaluronic acid-hyaluronectin interaction: application to the detection of hyaluronic acid in serum of normal subjects and cancer patients," Anal Biochem., 149(2):555-565 (1985).
Gao et al., "Hypoxia-induced alterations in hyaluronan and hyaluronidase," Adv Exp Med Biol. 566:249-256 (2005).
Halozyme Therapeutics, "Hylenex(R) recombinant (hyaluronidase human injection) and infiltration and extravasion," [online][retrieved on Apr. 3, 2013] Retrieved from:<URL:.hylenex.com/files/resources_docs/Infiltration-Extravasation/documentation/Hylenex%20recombinant%20and%20Infiltration-Extravasation.pdf, 7 pages.
Heldin, P., "Importance of hyaluronan biosynthesis and degradation in cell differentiation and tumor formation," Brazilian J. Med. Biol. Res., 36:967-973 (2003).
Jacobetz et al., "Hyaluronan impairs vascular function and drug delivery in a mouse model of pancreatic cancer," Gut., 62(1):112-120 (2013).
Jiang et al., "Effective targeting of the tumor microenvironment for cancer therapy," Anticancer Research 32:1203-1212 (2012).
Kultti et al., "Therapeutic targeting of hyaluronan in the tumor stroma," Cancers., 4(3):873-903 (2012).
Nykopp et al., "Expression of hyaluronan synthases (HAS1-3) and hyaluronidases (HYAL1-2) in serous ovarian carcinomas: inverse correlation between HYAL1 and hyaluronan content," BMC Cancer., 9:143, 9 pages (2009).
Plenat et al., "[Formaldehyde fixation in the third millennium]," Ann Pathol., 21(1):29-47 (2001). Abstract, 1 page.
Setala et al., "Hyaluronan expression in gastric cancer cells is associated with local and nodal spread and reduced survival rate," Br. J. Cancer 79(7-8):1133-1138 (1999).
Sun et al., "Selective tumor hypoxia targeting by hypoxia-activated prodrug TH-302 inhibits tumor growth in preclinical models of cancer," Clin. Cancer Res., 8(3):758-770 (2012).
Thylen et al., "Hyaluronan in serum as an indicator of progressive disease in hyaluronan-producing malignant mesothelioma," Cancer 86(10):2000-2005 (1999).
Toole et al., "Hyaluronan-cell interactions in cancer and vascular disease," J Biol Chem., 277(7):4593-4596. Epub date Nov. 20, 2001.
Whatcott et al., "Targeting the tumor microenvironment in cancer: why hyaluronidase deserves a second look," Cancer Discov., 1(4):291-296 (2011).
Dychter et al., "Targeting hyaluronan in tumor stroma. Interim translational and biomarker evaluations of pegylated hyaluronidase (PEGPH20) in animal models and patients with advanced solid tumors," European Organisation for Research and Treatment of Cancer-National Cancer Institute-American Society of Clinical Oncology (EORTC-NCI-ASCO) Annual Meeting on "Molecular Markers in Cancer", Oct. 27-29, 2011, Brussels, Belgium. European Journal of Cancer 47(Suppl.4):S30-S31, pp. 60. Abstract, 2 pages.
Frost, G., "Halozyme Therapeutics, Inc. Thinking outside the cell," Oct. 2013. Presentation, 46 pages.
Halozyme Therapeutics, J.P. Morgan Annual Healthcare Conference Presentation, Jan. 2013. Presentation, 18 pages.
Huang et al., "Characterization of a new recombinant HA binding protein: TSG6dHep-Fc," Presented at the Joint Meeting of the Society for Glycobiology & American Society of Matrix Biology, held on Nov. 11-14, 2012, San Diego, CA. Abstract #76, 1 page.
Huang et al., "Characterization of a new recombinant HA binding protein: TSG6dHep-Fc," Presented at the Joint Meeting of the Society for Glycobiology & American Society of Matrix Biology, held on Nov. 11-14, 2012, San Diego, CA. Poster #B10 and panels thereof, 7 pages.

Infante et al., "Targeting hyaluronan (HA) in tumor (T) stroma. Interim safety and translational evaluation of pegylated hyaluronidase (PEGPH20, P) in patients (PTS) with advanced solid tumors—a focus on GI malignancies," 2012 ASCO Gastrointestinal Cancers Symposium, Jan. 19-21, 2012, San Francisco, CA. Abstract No. 249, available on-line Jan. 12, 2012, 3 pages.
Jiang et al., "Hyaluronan (HA) accumulation in tumors correlates with response to pegylated rHuPH20 hyaluronidase (PEGPH20) in human tumors: a biomarker strategy," American Association for Cancer Research (AACR-EORTC) Annual Meeting, San Francisco, CA. Presented Nov. 14, 2011. Poster #B35 and panels thereof, 12 pages.
Jiang et al., "Hyaluronan (HA) accumulation in tumors correlates with response to pegylated rHuPH20 hyaluronidase (PEGPH20) in human tumors: a biomarker strategy," American Association for Cancer Research (AACR-EORTC) Annual Meeting, San Francisco, CA. Published on-line Nov. 12, 2011. Abstract #B35, 2 pages.
Jiang et al., "Effects of recombinant human PH20 (rHuPH20) on interstitial matrices: Creating a favorable environment for the delivery of cytostatic agents," [abstract]. In: Proceedings of the 96th Annual Meeting of the American Association for Cancer Research; Apr. 16-20, 2005; Anaheim, CA.:AACR; 2005. vol. 46, p. 1198, Abstract No. 5075, Apr. 2005.
Jiang et al., "Phase 1 pharmacodynamic activity of multiple-dose PEGylated hyaluronidase PH20 (PEGPH20) in patients with solid tumors," AACR Annual Meeting 2013 Apr. 6-10, 2013, Washington, D.C., Abstract 3375, [Retrieved from the internet Apr. 5, 2013], 1 page.
Jiang et al., "Phase 1 pharmacodynamic activity of multiple-dose PEGylated hyaluronidase PH20 (PEGPH20) in patients with solid tumors," AACR Annual Meeting 2013 Apr. 6-10, 2013, Washington, D.C., Poster 3375 and panels thereof, 11 pages.
Kadhim et al."Antitumor Activity of Pegylated Recombinant Human Hyaluronidase (PEGPH20) in Xenograft and Syngeneic Rat MatLyLu Prostate Carcinoma Models" Presented Apr. 19, 2009, AACR meeting 2009, Denver, CO., Poster #260 and panels thereof, 10 pages.
Kadhim et al., "PEGPH20: PEGylated Human Recombinant PH20 Hyaluronidase Shows Significant Antitumor Activity Concomitant with Hyaluronan Reduction in the PC3 Hormone Refractory Prostate Cancer Model" AACR 2009. Poster #8569 and panels thereof, 13 pages.
Kadhim et al., "Antitumor Activity of Pegylated Recombinant Human Hyaluronidase (PEGPH20) in Xenograft and Syngeneic Rat MatLyLu Prostate Carcinoma Models." AACR meeting Apr. 19, 2009; Abstract # 260, [accessed on-line Apr. 3, 2009], 1 page.
Kadhim et al., "Synergistic anti-tumor effect of pegylated recombinant human hyaluronidase (PEGrHuPH20) with cytotoxic agents following intravenous administration in a hormone refractory prostate cancer xenograft model," American Association for Cancer Research (AACR) Translational Cancer Medicine Meeting, Monterey, CA, Jul. 21, 2008, A45. Abstact #A45, 1 page.
Kadhim et al., "Synergistic anti-tumor effect of pegylated recombinant human hyaluronidase (PEGrHuPH20) with cytotoxic agents following intravenous administration in a hormone refractory prostate cancer xenograft model," American Association for Cancer Research (AACR) Translational Cancer Medicine Meeting, Monterey, CA, Jul. 21, 2008. Poster #A45 and panels thereof, 12 pages.
Kultti et al., "The role of hyaluronan-CD44 interaction in breast cancer," AACR Annual Meeting 2013 Apr. 6-10, 2013, Washington, D.C., Abstract # 511 [Retrieved from the internet Apr. 5, 2013], 1 page.
Kultti et al., "Extracellular hyaluronan accumulation by hyaluronan synthase 3 promotes pancreatic cancer growth and modulates tumor microenvironment via epithelial-mesenchymal transition," AACR Annual Meeting 2014. San Diego, CA Abstract #4844, Available on-line Mar. 2014 [Retrieved form the internet Mar. 18, 2014], 1 page.
Li et al., "Pegylated human recombinant hyaluronidase PH20 reduces solid tumor hypoxia," AACR Annual Meeting 2012. Available on-line Mar. 2012. [Retrieved from the interne Apr. 17, 2012], Abstract #3796, 1 page.

(56) References Cited

OTHER PUBLICATIONS

Li et al., "Abstract 3796: Pegylated human recombinant hyaluronidase PH20 reduces solid tumor hypoxia," Cancer Research 72(8; Suppl.1):3796 (2012).
Li et al., "Pegylated human recombinant hyaluronidase PH20 reduces solid tumor hypoxia," AACR Annual Meeting 2012, Presented Apr. 3, 2012. Poster #3796 and individual panels, 5 pages.
Li et al., "Tumor-targeted hyaluronan (HA) imaging with a recombinant HA binding protein: TSG6dHep-Fc," AACR Annual Meeting 2013 Apr. 6-10, 2013, Washington, D.C., Abstract #3915 [Retrieved from the internet Apr. 5, 2013], 1 page.
Maneval et al., "Phase 1 pharmacokinetics (PK) & pharmacodynamics (PD) of PEGylated hyaluronidase PH20 (PEGPH20) in patients with solid tumors," AACR Annual Meeting 2012. Available on-line Mar. 2012. [Retrieved from the Internet Apr. 17, 2012], Abstract #2672, 1 page.
Ramanathan et al., "Targeting hyaluronan in tumor stroma: Interim translational & biomarker evaluations of pegylated hyaluronidase (PEGPH20) in animal models & patients with advanced solid tumors," European Organisation for Research and Treatment of Cancer-National Cancer Institute-American Society of Clinical Oncology (EORTC-NCI-ASCO) Annual Meeting on "Molecular Markers in Cancer", Oct. 27-29, 2011, Brussels, Belgium. Poster and panels thereof, 12 pages.
Shepard et al., "Targeting hyaluronan (HA) in the tumor stroma. Translational evaluation of pegylated hyaluronidase (PEGPH20) in animal models and patients with advanced solid tumors" EORTC-ASCO-NCI meetin. Hollywood Florida, Oct. 19, 2010. Poster and panels thereof, 11 pages.
Shepard, M., "PEGPH20—A targeted therapy for cancer treatment," presented at Target Discovery World Congress, South San Francisco Aug. 4-5, 2009. Oral presentation, 13 pages.
Thompson et al., "Intravenous administration of recombinant human hyaluronidase (rHuPH20) modulates tumor interstitial fluid pressure and pericellular hyaluronan in a human prostate carcinoma xenograft model," American Association for Cancer Research Annual Meeting, 2008, San Diego, CA. Abstract, 1 page.
Thompson et al., "Intravenous administration of recombinant human hyaluronidase (rHuPH20) modulates tumor interstitial fluid pressure and pericellular hyaluronan in a human prostate carcinoma xenograft model," American Association for Cancer Research Annual Meeting, Apr. 12-16, 2008, San Diego, CA. Poster #2292 and panels thereof, 10 pages.
Thompson et al., "Pegylated recombinant human hyaluronidase PH20 (PEGPH20) increases tumor perfusion in mouse xenografts and phase 1 cancer patients," AACR Annual Meeting 2013 Apr. 6-10, 2013, Washington, D.C., Abstract #4955 [Retrieved from the internet Apr. 5, 2013], 1 page.
Thompson et al., "Pegylated recombinant human hyaluronidase PH20 (PEGPH20) increases tumor perfusion in mouse xenografts and phase 1 cancer patients," AACR Annual Meeting 2013 Apr. 6-10, 2013, Washington, D.C., Poster #4955 and panels thereof, 11 pages.
Thompson et al., "Pegylated Recombinant Human Hyaluronidase PH20 (PEGPH20) Reduces 18FDG-PET Uptake in Mouse Xenografts and Phase 1 Cancer Patients," Society of Nuclear Medicine and Molecular Imaging (SNMMI) 2013 Mid-Winter Meeting, Jan. 23-27, 2013, New Orleans, LA. Abstract, 1 page.
Thompson et al., "Pegylated Recombinant Human Hyaluronidase PH20 (PEGPH20) Reduces 18FDG-PET Uptake in Mouse Xenografts and Phase 1 Cancer Patients," Society of Nuclear Medicine and Molecular Imaging (SNMMI) 2013 Mid-Winter Meeting, Jan. 23-27, 2013, New Orleans, LA. Poster #73 and panels thereof, 10 pages.
Torley, H., "Halozyme Therapeutics, Inc. The next chapter begins: creating value through growth," Presented at the 32nd Annual J.P. Morgan Healthcare Conference Jan. 2014, 27 pages.
Whatcott et al., "Hyaluronan deposition correlates with poor survival in pancreatic cancer," American Association of Cancer Research Annual Meeting, Orlando, FL Apr. 5, 2011. Abstract, 1 page.

Halozyme Therapeutics Investor Presentation, "Halozyme Therapeutics, Inc.: Thinking outside the cell," Presented on Oct. 2, 2012 [online][retrieved on Oct. 11, 2012] Retrieved from:<URL:sec.gov/Archives/edgar/data/1159036/000119312512412748/d419091dex991.htm, 82 pages.
News release, "Halozyme studies target hyaluronan surrounding solid tumors, May offer new approach to cancer treatment," Published on Apr. 20, 2009 [online][retrieved on Feb. 17, 2014], Retrieved from:<URL:halozyme.com/Investors/News-Releases/News-Release-Details/2009/Halozyme-Studies-Target-Hyaluronan-Surrounding-Solid-Tumors-May-Offer-New-Approach-to-Cancer-Treatment/default.aspx, 3 pages.
News Release, Halozyme Therapeutics, Inc., "Halozyme therapeutics announces positive findings with pegylated enzyme in prostate cancer models," Published on Jul. 22, 2008[online][retrieved on Dec. 29, 2009] Retrieved from:<URL: drugs.com/clinical_trials/halozyme-therapeutics-announces-positive-findings-pegylated-enzyme-prostate-cancer-models-5142.html, 5 pages.
News Release, Halozyme Therapeutics, Inc., "Halozyme therapeutics presents pre-clinical studies with systemic delivery of pegylated rHuPH20 enzyme in prostate cancer models at American Association for Cancer Research," Published on Apr. 15, 2008[online][retrieved on Jul. 16, 2009] Retrieved from:<URL:halozyme.com/Investors/News-Releases/News-Release-Details/2008/Halozyme-Therapeutics-Presents-Pre-Clinical-Studies-of-Systemic-Delivery-of-Pegylated-rHuPH20-Enyzme-in-Prostate-Cancer-Model/default.aspx, 3 pages.
News Release, Halozyme Therapeutics, Inc., "Halozyme therapeutics, inc. begins phase 1 clinical study with PEGPH20 in cancer patients with refractory solid tumors," Published on Mar. 31, 2009[online][retrieved on Apr. 27, 2010] Retrieved from:<URL:in.reuters.com/money/quotes/keyDevelopments?symbol=HALO.O, 1 page.
News Release, Halozyme Therapeutics, Inc., "PEGPH20 enzyme re-expands insides of blood vessels to allow more drugs to reach tumours," Published on Mar. 21, 2012 [online][retrieved on Aug. 7, 2012] Retrieved from:<URL:news-medical.net/news/20120321/PEGPH20-enzyme-re-expands-insides-of-blood-vessels-to-allow-more-drugs-to-reach-tumours.aspx, 1 page.
News Release, Halozyme Therapeutics, Inc., "Halozyme Therapeutics announces data from two phase 1 studies of PEGPH20 demonstrating targeting of hyaluronan in tumor stroma," Published on Oct. 27, 2011[online] [retrieved on Nov. 17, 2011] Retrieved from:<URL:halozyme.com/Investors/News-Releases/News-Release-Details/2011/Halozyme-Therapeutics-Announces-Data-From-Two-Phase-1-Studies-of-PEGPH20-Demonstrating-Targeting-of-Hyaluronan-in-Tumor-Strom/default.aspx, 3 pages.
Transcript, "Halozyme Therapeutics's CEO hosts analyst/investor day conference call (Transcript)," Published on Oct. 2, 2012 [online][retrieved on Oct. 25, 2012] Retrieved from: <URL:seekingalpha.com/article/901141-halozyme-therapeutics-s-ceo-hosts-analyst-investor-day-conference-call-transcript?part=single, 49 pages.
News Release, "Halozyme Therapeutics to present at the 31st Annual J.P. Morgan Healthcare Conference," Published Jan. 3, 2013 [online][Retrieved Jan. 17, 2013][Retrieved from:<URL:halozyme.com/Investors/News-Releases/News-Release-Details/2013/Halozyme-Therapeutics-to-Present-at-the-31st-Annual-JP-Morgan-Healthcare-Conference1132508/default.aspx, 2 pages.
News Release, "Halozyme Begins Randomized, Controlled Clinical Trial with PEGPH2O in Patients with Advanced Pancreatic Cancer," Published Oct. 5, 2011 [online][Retrieved Jul. 16, 2013][located at <URL:halozyme.com/Investors/News-Releases/News-Release-Details/2011/Halozyme-Begins-Randomized-Controlled-Clinical-Trial-with-PEGPH20-in-Patients-with-Advanced-Pancreatic-Cancer1126802/default.aspx], 1 page.
News Release, "Halozyme Initiates Randomized Phase 2 Trial of PEGPH20 in Pancreatic Cancer," Published Apr. 23, 2013 [online][Retrieved May 16, 2013] Retrieved from the Internet: URL: http://www.halozyme.com/Investors/News-Releases/News-Release-Details/2013/Halozyme-Initiates-Randomized-Phase-2-Trial-of-PEGPH20-in-Pancreatic-Cancer/default.aspx, 3 pages.

(56) References Cited

OTHER PUBLICATIONS

News Release, "Halozyme to Present New Data on PEGPH20 in Pancreatic Cancer at American Society of Clinical Oncology Annual Meeting," Published May 15, 2013 [online][Retrieved May 16, 2013][Retrieved from:<URL:halozyme.com/Investors/News-Releases/News-Release-Details/2013/Halozyme-To-Present-New-Data-On-PEGPH20-In-Pancreatic-Cancer-At-American-Society-of-Clinical-Oncology-Annual-Meeting/default.aspx, 3 pages.
Invitation to Pay Additional Fees and Partial International Search Report, mailed Jan. 31, 2014, in connection with International Patent Application No. PCT/US2013/065326, 7 pages.
Letter/Written Disclosure of the Supplemental Information Disclosure Statement for the above-referenced application, mailed Jan. 16, 2015, 2 pages.
Derwent English abstract for Chinese patent CN 101899118, published Dec. 1, 2010, entitled: "New fusion protein of hyaluronan binding protein and monomeric Katushka, useful for measuring hyaluronic acid," Derwent World Patents Index, Accession Nbr. 2011A34910, 2 pages.
Hiltunen et al., "Elevated hyaluronan concentration without hyaluronidase activation in malignant epithelial ovarian tumors," Cancer Res. 62(22):6410-6413 (2002).
Huang et al., "Characterization of hyaluronan, hyaluronidase PH20, and HA synthase HAS2 in inflammation and cancer," Inflammation & Cell Signaling, 1:e306, 6 pages (2014).
Jadin et al., "Characterization of a novel recombinant hyaluronan binding protein for tissue hyaluronan detection," J Histochem Cytochem. 62(9):672-683 (2014).
Kultti et al., "Accumulation of extracellular hyaluronan by hyaluronan synthase 3 promotes tumor growth and modulates the pancreatic cancer microenvironment," Biomed Res Int., 2014:817613, 15 pages (2014).
Paiva et al., "Expression patterns of hyaluronan, hyaluronan synthases and hyaluronidases indicate a role for hyaluronan in the progression of endometrial cancer," Gynecol Oncol. 98(2):193-202 (2005).
Pritzker, K., "Cancer biomarkers: easier said than done," Clin Chem. 48(8):1147-1150 (2002).
Stern, R., "Hyaluronidases in cancer biology," Semin Cancer Biol. 18(4):275-280 (2008).
Singha et al., "Hyaluronan (HA) depletion sensitizes HA(high) tumors to antibody-dependent cell-mediated cytotoxicity," presented at San Antonio Breast Cancer Symposium (SABCS), Dec. 9-13, 2014. San Antonio, TX. Abstract P5-04-02, 1 page.
Singha et al., "Hyaluronan (HA) depletion sensitizes HA(high) tumors to antibody-dependent cell-mediated cytotoxicity," presented at San Antonio Breast Cancer Symposium (SABCS), Dec. 9-13, 2014. San Antonio, TX. Poster P5-04-02, 6 pages.
Zhao et al, "Naked mole rat HAS2 and hyaluronan are not tumor suppressive in human tumor xenografts," presented at San Antonio Breast Cancer Symposium (SABCS), Dec. 9-13, 2014. San Antonio, TX. Abstract P4-04-25, 1 page.
Zhao et al, "Naked mole rat HAS2 and hyaluronan are not tumor suppressive in human tumor xenografts," presented at San Antonio Breast Cancer Symposium (SABCS), Dec. 9-13, 2014. San Antonio, TX. Poster P4-04-25, 6 pages.

News Release, Halozyme Therapeutics Inc. "Findings from Halozyme Therapeutics in the Area of Coenzymes Described (Characterization of a Novel Recombinant Hyaluronan Binding Protein for Tissue . . . ," 4-Traders. Published Nov. 5, 2014 [online][retrieved on Jan. 14, 2015] Retrieved from:<URL:4-traders.com/news/Findings-from-Halozyme-Therapeutics-in-the-Area-of-Coenzymes-Described-Characterization-of-a-Novel--19340628/ [1 page].
International Search Report and Written Opinion, mailed Mar. 31, 2014, in connection with International Patent Application No. PCT/US2013/065326, 20 pages.
Response, dated Aug. 18, 2014, to Written Opinion, mailed Mar. 31, 2014, in connection with International Patent Application No. PCT/US2013/065326, 34 pages.
Second Written Opinion mailed Dec. 9, 2014, in connection with International Patent Application No. PCT/US2013/065326, 10 pages.
Letter/Written Disclosure of the Supplemental Information Disclosure Statement for the above-referenced application, filed herewith Aug. 20, 2015, 2 pages.
Busch et al., "Depletion of tumor oxygenation during photodynamic therapy: detection by the hypoxia marker EF3 [2-(2-Nitroimidazol-1[H]-yl)-N-(3,3,3-trifluoropropyl)acetamide] 1," Cancer Research 60(15):2636-2642 (2000).
Li et al., "Pegylated human recombinant hyaluronidase PH20 reduces solid tumor hypoxia," Poster Associated with Abstract 3796, Cancer Research 72(8):3796, 5 pages (2012).
Li et al., "Pegylated human recombinant hyaluronidase PH20 reduces solid tumor hypoxia," Abstract 3796, Cancer Research 72(8):3796, 1 page (2012).
Greenway, S., "The Next Chapter Begins: Creating Value Through Growth," Presented at the JMP Securities 2015 Life Sciences Conference, Jun. 24, 2015, 24 pages.
Torley, H., "UBS Global Health Care Conference," Presented at the UBS Global Health Care Conference May 18, 2015, 21 pages.
Torley, H., "Halozyme Therapeutics, Inc. The next chapter begins: creating value through growth," Presented at the 32nd Annual J.P. Morgan Healthcare Conference Jan. 2014, 26 pages.
Whatcott et al., "Abstract 191: Desmoplasia in primary tumors and metastatic lesions of pancreatic cancer," Cancer Res 74; 191 (2014) [Proceedings: AACR Annual Meeting 2014; Apr. 5-9, 2014; San Diego, CA].
News Release, Halozyme Therapeutics, Inc., "Eisai and Halozyme Sign Collaboration Agreement to Investigate Eribulin and PEGPH20 in Metastatic Breast Cancer," Published Jul. 31, 2015 [online], Retrieved from: <URL:halozyme.com/Investors/News-Releases/News-Release-Details/2015/Eisai-and-Halozyme-Sign-Collaboration-Agreement-to-Investigate-Eribulin-and-PEGPH20-in-Metastatic-Breast-Cancer/default.aspx [retrieved on Aug. 11, 2015], 4 pages.
Response, dated Feb. 9, 2015, to Written Opinion, mailed Dec. 9, 2014, in connection with International Patent Application No. PCT/US2013/065326, 77 pages.
U.S. Appl. No. 13/998,040, filed Sep. 24, 2013.
U.S. Appl. No. 13/999,061, filed Jan. 7, 2014.

* cited by examiner

HYPOXIA AND HYALURONAN AND MARKERS THEREOF FOR DIAGNOSIS AND MONITORING OF DISEASES AND CONDITIONS AND RELATED METHODS

RELATED APPLICATIONS

Benefit of priority is claimed to U.S. Provisional Application Ser. No. 61/714,718, entitled "Hyaluronan-Associated Markers for Diagnosis of Hypoxia-Related Diseases and Conditions and Methods of Treatment Thereof," filed Oct. 16, 2012, and to U.S. Provisional Application Ser. No. 61/852, 177, entitled "Methods of Diagnosis and Monitoring Using Hyaluronan-Associated and Hypoxia Markers and Related Uses and Treatments," filed Mar. 14, 2013. The subject matter of each of the above-noted applications is incorporated by reference in its entirety.

This application is related to International PCT Application No. PCT/US2013/065326, filed the same day herewith, entitled "Hypoxia and Hyaluronan And Markers Thereof for Diagnosis and Monitoring of Diseases and Conditions and Related Methods," which claims priority to U.S. Provisional Application No. 61/714,718 and U.S. Provisional Application No. 61/852,177.

The subject matter of each of the above-noted applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy 1 and Copy 2), the contents of which are incorporated by reference in their entirety. The computer-readable file on each of the aforementioned compact discs, created on Oct. 16, 2013, is identical, 1,842 kilobytes in size, and titled 3111SEQ.001.txt.

FIELD OF THE INVENTION

Provided herein are diagnostic methods for identifying subjects susceptible to treatment with a hypoxia-activated agent, and related methods. Also provided herein are methods of monitoring treatments with anti-hyaluronan agents, and related methods.

BACKGROUND

Cancer is one of the major causes of human morbidity and mortality. Cancer treatment is challenging because it is difficult to kill cancer cells without damaging or killing normal cells. Damaging or killing normal cells during cancer treatment causes adverse side effects in patients and can limit the amount of anticancer drug administered to a cancer patient. Certain cancer cells can differ from certain normal cells in their level of oxygenation and can be more hypoxic than normal cells. Given the importance of hypoxia in tumorigenesis and metastasis, there is a need to identify improved methods for selective treatment of subjects having a hypoxia-related disease or condition.

SUMMARY

Provided herein is a method of treating a subject having a hypoxia-related disease or condition that includes a) measuring the level or amount of a hyaluronan-associated marker in a sample from a subject, whereby if the marker is at or above a predetermined level, the subject is susceptible for treatment with a hypoxia-activated agent; b) selecting a susceptible subject for treatment with a hypoxia-activated agent; and c) administering a therapeutically effective amount of a hypoxia-activated agent to the subject. Also provided herein are methods of selecting a subject for treatment of a hypoxia-related disease or condition with a hypoxia-activated agent by: a) measuring the level or amount of a hyaluronan-associated marker in a sample from a subject; b) if the marker is at or above a predetermined level, the subject is susceptible to treatment with a hypoxia-activated agent to treat the hypoxia-related disease or condition; and c) selecting a susceptible subject for treatment with a hypoxia-activated agent. The selected subject then is treated.

In any of the methods provided herein, the hypoxia-related disease or condition is a hyperproliferative disease or condition. For example, the hypoxia-related disease or condition is cancer, angiogenesis or an angiogenesis related disorder. In particular, the hypoxia-related disease or condition is a cancer. The cancer can be a tumor or a solid tumor. The cancer can be a late-stage cancer, a metastatic cancer and an undifferentiated cancer. The cancer can be any one or more of breast cancer, pancreatic cancer, ovarian cancer, colon cancer, lung cancer, non-small cell lung cancer, in situ carcinoma (ISC), squamous cell carcinoma (SCC), thyroid cancer, cervical cancer, uterine cancer, prostate cancer, testicular cancer, brain cancer, bladder cancer, stomach cancer, hepatoma, melanoma, glioma, retinoblastoma, mesothelioma, myeloma, lymphoma, and leukemia.

In any of the methods, provided herein, the hyaluronan-associated marker is hyaluronan (HA), a hyaluronidase or a hyaluronan synthase. In particular, the hyaluronan-associated marker is hyaluronan (HA). In any of the methods, uses or pharmaceutical compositions provided herein, the sample can be a tissue, cell and bodily fluid. For example, the sample is a tumor. Detection of the level or amount of the marker can be effected by immunohistochemistry, histology, ELISA, an ELISA-like assay, Western Blot, flow cytometry, PCR or RT-PCR.

For any of the methods provided herein, the subject is one that is selected as having elevated amount or level of hyaluronan compared to a predetermined level. Hence, for practice of any of the methods herein or for the purpose of the selected subjects in the uses and pharmaceutical compositions for use herein, the predetermined level can be determined based on the level or amount of the marker in a control or reference sample. The control or reference sample can be: an analogous sample from another subject that is a normal subject; an analogous sample from a subject known to express low hyaluronan in the sample; or a cell line. The predetermined level can be the mean or median level or amount of the hyaluronan-associated marker in a sample from a healthy subject. For example, the predetermined level is the mean or median level or amount of the hyaluronan-associated marker in a sample from a subject known to have a hypoxia-related disease or condition. In any of such examples, the subject is selected if the level or amount is elevated at least 0.5-fold, 1-fold, 2-fold, 3-fold, 4-fold, 5-fold, 6-fold, 7-fold, 8-fold, 9-fold, 10-fold or more compared to the predetermined level.

In any of the methods provided herein, the marker is hyaluronan and the marker is measured by detecting binding of an HA-binding protein to the sample. For example, the predetermined level is moderate to high HA and a subject is selected for treatment if moderate to high hyaluronan is measured. In one example, the predetermined level is at least or above 0.010 μg HA/mL, 0.015 μg HA/mL, 0.020 μg HA/mL, 0.025 µg HA/mL of sample, 0.030 µg/mL, 0.035 µg/mL, 0.040 µg/mL, 0.045 µg/mL, 0.050 µg/mL, 0.055 µg/mL, 0.060 µg/mL, 0.065 µg/mL, 0.070 µg/mL, 0.08 µg/mL, 0.09 µg/mL, 0.1 µg/mL, 0.2 µg/mL, 0.3 µg/mL or more. In particular, the sample is a tumor and a subject is selected for treatment if moderate to high hyaluronan is measured. In such an example, moderate to high hyaluronan is measured if hyaluronan is present on at least 10%, 10% to 25%, or greater than 25% of the tumoral area. For example, moderate to high hyaluronan is measured if hyaluronan is present on at least 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more of the tumoral area. In aspects of any of the methods, uses or pharmaceutical compositions herein, the subject is selected for treatment if high hyaluronan is measured; and high hyaluronan is measured if hyaluronan is present on at least or greater than 25% or more of the tumoral area.

In any of the methods provided herein, the HABP contains a link module. In some aspects, the HABP contains two or more link modules. The link module or modules can be the only HABP portion of the molecule. For example, the HABP contains a link module from CD44, lymphatic vessel endothelial hyaluronan receptor (LYVE)-1, Hyaluronan and Proteoglycan Link Protein 1 (HAPLN1)/link protein, HAPLN2, HAPLN3, HAPLN4, aggrecan, versican, neurocan, brevican, phosphacan, Tumor necrosis factor-Stimulated Gene-6 (TSG-6), Stabilin-1, Stabilin-2, CAB61358 or KIAA0527 or a portion thereof that contains a link module or a sufficient portion of a link module to bind HA.

In any of the methods provided herein, the HABP contains a link module. In some aspects, the HABP contains two or more link modules. The link module or modules can be the only HABP portion of the molecule. For example, the HABP contains a link module from CD44, lymphatic vessel endothelial hyaluronan receptor (LYVE)-1, Hyaluronan and Proteoglycan Link Protein 1 (HAPLN1)/link protein, HAPLN2, HAPLN3, HAPLN4, aggrecan, versican, neurocan, brevican, phosphacan, Tumor necrosis factor-Stimulated Gene-6 (TSG-6), Stabilin-1, Stabilin-2, CAB61358 or KIA0527 or a portion thereof that contains a link module or a sufficient portion of a link module to bind HA.

In any of the methods provided herein, the HABP contains a G1 domain of a type C hyaluronan binding protein. For example, the HABP contains a G1 domain from Aggrecan G1, Versican G1, Neurocan G1 or Brevican G1. In some aspects, the G1 domain is the only HABP portion of the molecule.

In any of the methods provided herein, the HABP contains the sequence of amino acids set forth in any of SEQ ID NOS: 207, 222, 360, 361, 371-394, 416-418 and 423-426 or a sequence of amino acids that exhibits at least 65%, 70%, 75%, 80%, 85%, 90%, 91%, 92%, 93%, 94%, 95%, 96%, 97%, 98%, 99% or more sequence identity to a sequence of amino acids set forth in any of SEQ ID NOS: 207, 222, 360, 361, 371-394, 416-418 and 423-426 and specifically binds HA, or an HA-binding domain thereof or a sufficient portion thereof to specifically bind to HA.

In particular aspects of any of the methods provided herein, the HABP contains a TSG-6 link module (LM) or a sufficient portion thereof that specifically binds HA. For example, the TSG-6-LM has the sequence of amino acids set forth in SEQ ID NOS: 207, 360, 417 or 418, or a sequence of amino acids that has at least 65% amino acid sequence identity to the sequence of amino acids set forth in SEQ ID NOS: 207, 360, 417 or 418 and specifically binds HA, such as at least 70%, 75%, 80%, 85%, 90%, 91%, 92%, 93%, 94%, 95%, 96%, 97%, 98%, 99% or more sequence identity to the sequence of amino acids set forth in SEQ ID NOS: 207, 360, 417 or 418, whereby the HABP specifically binds HA. In some examples, the TSG-6 link module is modified to reduce or eliminate binding to heparin. The binding to heparin can be reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more. For example, included among HABPs is an HAPB containing a TSG-6 link module having an amino acid replacement at an amino acid position corresponding to amino acid residue 20, 34, 41, 54, 56, 72 or 84 set forth in SEQ ID NO:360, whereby a corresponding amino acid residue is identified by alignment to a TSG-6-LM set forth in SEQ ID NO:360. For example, the amino acid replacement is in a TSG-6-LM set forth in SEQ ID NO:207 and the amino acid replacement or replacements is at amino acid residue 21, 35, 42, 55, 57, 73 or 85. The amino acid replacement can be to a non-basic amino acid residue selected from among Asp (D), Glu (E), Ser (S), Thr (T), Asn (N), Gln (Q), Ala (A), Val (V), Ile (I), Leu (L), Met (M), Phe (F), Tyr (Y) and Trp (W). In particular examples, the TSG-6 link module contains an amino acid replacement corresponding to amino acid replacement K20A, K34A or K41A in a TSG-6-LM set forth in SEQ ID NO:360 or the replacement at the corresponding residue in another TSG-6-LM, such as amino acid replacements corresponding to amino acid replacements K20A, K34A and K41A in a TSG-6-LM set forth in SEQ ID NO:360 or the replacement at the corresponding residue in another TSG-6-LM. For example, the HABP contains a link module set forth in SEQ ID NO:361 or 416 or a sequence of amino acids having at least 65% amino acid sequence identity to the sequence of amino acids set forth in SEQ ID NO:361 or 416 that specifically binds HA, such as at least 70%, 75%, 80%, 85%, 90%, 91%, 92%, 93%, 94%, 95%, 96%, 97%, 98%, 99% or more sequence identity to the sequence of amino acids set forth in SEQ ID NO:361 or 416, whereby the HABP specifically binds HA. In particular, the HABP contains a link module set forth in SEQ ID NO:361 or SEQ ID NO:416. In any of such molecules described above, the link module is the only TSG-6 portion of the HABP.

In any of the methods provided herein, the HABP is a multimer containing a first HA-binding domain linked directly or indirectly via a linker to a multimerization domain and a second HA-binding domain linked directly or indirectly via a linker to a multimerization domain. The HA-binding domain is a link module or a G1 domain. The first and second HA-binding domain is the same or different. In particular examples, the first and second HA-binding domain is a TSG-6 link module, a variant thereof or a sufficient portion thereof that specifically binds to HA. For example, the TSG-6-LM is one that contains the sequence of amino acids set forth in SEQ ID NOS: 207, 360, 361, 416, 417 or 418 or a sequence of amino acids that has at least 65% amino acid sequence identity to the sequence of amino acids set forth in SEQ ID NOS: 207, 360, 361, 416 417 or 418 that specifically binds HA, such as at least 70%, 75%, 80%, 85%, 90%, 91%, 92%, 93%, 94%, 95%, 96%, 97%, 98%, 99% or more sequence identity to the sequence of amino acids set forth in SEQ ID NOS: 207, 360, 361, 416, 417 or 418, whereby the HABP specifically binds HA. The link module can contain the sequence of amino acids set forth in SEQ ID NOS: 207, 360, 361, 416, 417 or 418.

In any of the methods provided herein, the HABP used for selection is one that contains a multimerization domain and the multimerization domain is an immunoglobulin constant region (Fc), a leucine zipper, complementary hydrophobic regions, complementary hydrophilic regions, compatible protein-protein interaction domains, free thiols that form an intermolecular disulfide bond between two molecules, or a protuberance-into-cavity and a compensatory cavity of identical or similar size that form stable multimers. For example, the multimerization domain is an Fc domain or a variant thereof that effects multimerization. The Fc domain can be from an IgG, IgM or an IgE. Included among Fc domains as a multimerization domain is the Fc domain that has the sequence of amino acids set forth in SEQ ID NO:204, 359 or exhibits at least 75% sequence identity to SEQ ID NO: 204 or 359.

For example, in any of the methods provided herein, the HABP is a fusion protein that contains a TSG-6 link module and an immunoglobulin Fc domain. In such examples, the HABP is TSG-6-LM-Fc that is a polypeptide encoded by a nucleic acid molecule that encodes the sequence of amino acids set forth in SEQ ID NO:212 or a sequence of amino acids that exhibits at least 65% amino acid sequence identity to SEQ ID NO:212 and specifically binds HA, such as at least 70%, 75%, 80%, 85%, 90%, 91%, 92%, 93%, 94%, 95%, 96%, 97%, 98%, 99% or more sequence identity to the sequence of amino acids set forth in SEQ ID NO:212, whereby the HABP specifically binds HA. For example, the HABP is TSG-6-LM-FC/AHep that is a polypeptide encoded by a nucleic acid molecule that encodes the sequence of amino acids set forth in SEQ ID NO 215 or a sequence of amino acids that exhibits at least 65% amino acid sequence identity to SEQ ID NO:215 and specifically binds HA, such as at least 70%, 75%, 80%, 85%, 90%, 91%, 92%, 93%, 94%, 95%, 96%, 97%, 98%, 99% or more sequence identity to the sequence of amino acids set forth in SEQ ID NO:215, whereby the HABP specifically binds HA. In particular the HABP is a polypeptide encoded by a nucleic acid molecule that encodes the sequence of amino acids set forth in SEQ ID NO:212 or 215.

In any of the methods provided herein, the sample has been previously obtained from the subject.

In any of the methods herein, the method also includes after selecting a subject susceptible to treatment with a hypoxia-activated agent, administering a hypoxia-activated agent to the susceptible subject to treat the disease or condition. Hence, in any of the methods, uses or pharmaceutical compositions provided herein, the hypoxia-activated agent is a hypoxia-activated prodrug or a conjugate thereof. The hypoxia-activated prodrug contains a bioreductive group that is reducible by a one electron reductase. For example, the one electron reductase is diflavin reductase NADPH-cytochrome P450 reductase (CYPOR), inducible nitric-oxide synthase (iNOS), NADPH-dependent diflavin oxidoreductase 1 (NDOR1), methionine synthase reductase (MTRR), NADH-cytochrome b5 reductase, ferredoxin reductase (FDXR), xanthine oxidase and xanthine dehydrogenase.

For example, in any of the methods provided herein, the bioreductive group is a quinone, aromatic N-oxide, aliphatic N-oxide, nitroheterocyclic compound and transition-metal complex. In examples where the bioreductive group is a quinone, the hypoxia-activated prodrug can be a mitomycin C, porfiromycin, cyclopropamitosene, diaziquone, streptonigrin, EO9 or RH1 or derivatives or analogs thereof. In examples, where the bioreductive group is an aromatic N-oxide, the hypoxia-activated prodrug can be a tirapazamine or CEN-209 or derivatives or analogs thereof. In examples wherein the bioreductive group is an aliphatic N-oxide, the hypoxia-activated prodrug can be a AQ4N or Nitracrine N-Oxide or a derivative or analog thereof. In examples where the bioreductive group is a nitroheterocyclic compound, the hypoxia-activated prodrug can be a PR-104, SN28343, SN29303, SN29730, KS119W, NLCQ-1, RSU1069, RB6145, CB1954 and SN23862. In examples wherein the bioreductive group is a transition-metal complex, the hypoxia-activated prodrug is SN24771.

In any of the methods provided herein, the hypoxia-activated prodrug can contain a bioreductive group linked directly or indirectly to an anti-neoplastic agent. For example, the bioreductive group is a nitroheterocyclic compound, such as a nitroimidazole or a substituted moiety thereof. In any of such examples, the anti-neoplastic agent can be an anti-angiogenic agent, alkylating agents, antimetabolite, microtubulin polymerization perturbers, platinum coordination complexes, anthracenediones, substituted ureas, methylhydrazine derivatives, adrenocortical suppressants, hormones and antagonists, anti-cancer polysaccharides or anthracycline. For example, wherein the anti-neoplastic agent is an anthracycline it can be an aclarubicin, daunorubicin, doxorubicin, epirubicin, idarubicin, mitoxantrone, pirarubicin, valrubicin or a derivatives or analogs thereof. In examples where the anti-neoplastic agent is an alkylating agent it can be a phosphoramidate-based alkylator. The phosphoramidate-based alkylator can be a cyclophosphamide or ifosfamide or derivatives or analogs thereof. For example, the hypoxia-activated agent is TH-281, TH-308 or TH-302. In other aspects, the anti-neoplastic agent can be a maytansine, enediyenes, discodermolide, epothilone, taxane, calicheamicin, tedanolide, etoposide, vinblastine, vincristine, topotecan, 5-fluorouracil or prodrugs thereof, camptothecin, bleomycins, calicheamicins, colchicine, cyanamide, dacarbazine, dactinomycin, discodermolide, epothilones, etoposide, Combretastatin A-4, fludarabine, hydroxyurea, hydroxyureapentostatin, maytansine, 6-mercaptopurine, methotrexate, mitomycin, carboplatin, cisplatin, prednisone, procarbazine, tedanolide, teniposide, 6-thioguanine, topotecan and vinca alkaloids or vincristine, or analogs thereof. For example, where the anti-neoplastic agent is a camptothecin, the hypoxia-activated agent is TH-1332 or TH-1431. In further aspects, the anti-neoplastic agent is a pan-Her inhibitor. For example, the pan-Her inhibitor can be HKI-272, BIBW-2992, PF299, SN29926 or PR-509E. In such examples, the hypoxia-activated agent is SN29966, SN32807, PR-509 or PR-610.

In any of the methods, provided herein, the hypoxia-activated prodrug is a conjugate containing a hypoxia-activated prodrug linked directly or indirectly to a biomacromolecule. For example, the biomacromolecule is an agent that targets to a tumor. In particular examples, the biomacromolecule can be a apo-transferrin, Fe-transferrin, Ru-transferrin, Ti-transferrin, Ga-transferrin, Pt-transferrin, somatostatin, epidermal growth factor, folic acid or transcobalamin.

In any of the methods herein, the hypoxia-activated agent is administered in an amount that is 0.01 mg/m$^2$ to 10,000 mg/m$^2$, 0.1 mg/m$^2$ to 5000 mg/m$^2$, 1 mg/m$^2$ to 3000 mg/m$^2$, 10 mg/m$^2$ to 2000 mg/m$^2$, 100 mg/m$^2$ to 1000 mg/m$^2$, 100 mg/m$^2$ to 500 mg/m$^2$, or 400 mg/m$^2$ to 800 mg/m$^2$. The hypoxia-activated agent can be formulated for intratumoral, systemic, intraperitoneal or oral administration and/or is administered by intratumoral administration, systemically, intraperitoneally or orally. In particular examples, the hypoxia-activated agent is administered by intravenous infusion.

In any of the methods herein, the method further includes administration of a second cancer treatment. The cancer treatment can be a surgery, radiation, a chemotherapeutic agent, a biological agent, a polypeptide, an antibody, a peptide, a small molecule, a gene therapy vector, a virus or DNA. For example, the second agent is an anti-cancer agent that is Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Doxorubicin Dibrospidiums; Dienogests; Dinalins; Disermolides; Docetaxels; Dofequidars; Doxifluridines; Doxorubicin liposomals; Doxorubicin HCl; Docorubicin HCl liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Emofosines; Ilomastats; Imatinib mesylates; Imexons; Improsulfans; Indisulams; Inproquones; Interferon alfa-2 as; Interferon alfa-2bs; Interferon Alfas; Interferon Betas; Interferon Gammas; Interferons; Interleukin-2s and other Interleukins (including recombinant Interleukins); Intoplicines; lobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Meclorethamines/Nitrogen mustards; Megestrol acetates; Megestrols; Melengestrols; Melphalans; MelphalanslL-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofirans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; or Zosuquidars.

In any of the methods herein involving administration of a second agent, the second agent is an anti-hyaluronan agent. The anti-hyaluronan agent can be a hyaluronan degrading enzyme or is an agent that inhibits hyaluronan synthesis. For example, the anti-hyaluronan agent is an agent that inhibits hyaluronan synthesis and is a sense or antisense nucleic acid molecule against an HA synthase or is a small molecule drug. In particular examples, the anti-hyaluronan agent is a small molecule drug that is 4-methylumbelliferone (MU) or a derivative thereof, or leflunomide or a derivative thereof. The small molecule drug can be a derivative of 4-methylumbelliferone (MU) that is 6,7-dihydroxy-4-methyl coumarin or 5,7-dihydroxy-4-methyl coumarin.

In any of the methods herein involving administration of a second agent, the the second agent can be a hyaluronan degrading enzyme. The hyaluronan degrading enzyme can be administered intravenously. The hyaluronan-degrading enzyme can be one that is glycosylated, aglycosylated or modified to exhibit reduced glycosylation. The hyaluronan-degrading enzyme can be administered by continuous infusion. For example, the anti-hyaluronan agent is a hyaluronan degrading enzyme that is administered by intratumoral administration, arterial injection, intraperitoneal administration, or intravesical administration.

In any of the methods herein involving administration of a second agent, the the second agent can be a hyaluronan degrading enzyme that is modified by conjugation to a polymer. The polymer can be PEG and the hyaluronan degrading enzyme is PEGylated. For example, the PEG moiety can be one that results from reaction with a PEG reagent that is methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy-poly(ethylene glycol)-succinimidyl propionate (mPEG-SPA) (20 kDa); methoxy-poly(ethylene glycol)-succinimidyl propionate (mPEG-SPA) (30 kDa); (methoxy-poly(ethylene glycol))$_2$-N-hydroxysuccinimide ester (mPEG$_2$-NHS) (10 kDa branched); (methoxy-poly(ethylene glycol))$_2$-N-hydroxysuccinimide ester (mPEG$_2$-NHS) (20 kDa branched); (methoxy-poly(ethylene glycol))$_2$-N-hydroxysuccinimide ester (mPEG$_2$-NHS) (40 kDa branched); (methoxy-poly(ethylene glycol))$_2$-N-hydroxysuccinimide ester (mPEG$_2$-NHS) (60 kDa branched); biotin-poly(ethylene glycol)-N-hydroxysuccinimide ester (biotin-PEG-NHS) (5 kDa biotinylated); poly(ethylene glycol)-p-nitrophenyl carbonate (PEG-p-nitrophenyl-carbonate) (30 kDa); or poly(ethylene glycol)-propionaldehyde (PEG-propionaldehyde) (30 kDa). The PEG can be a branched or linear PEG. For example, the PEG is a methoxy-PEG (mPEG). In other examples, the PEG is a linear N-hydroxysuccinimidyl ester of methoxy poly(ethylene glycol) butanoic acid. In particular examples, the PEG has a weight of 30 or about 30 kilodaltons.

In any of the methods herein involving administration of an anti-hyaluronan agent that is a hyaluronan-degrading enzyme or modified form thereof (e.g., PEGylated form), the hyaluronan degrading enzyme can be hyaluronidase. The hyaluronidase can be a PH20 hyaluronidase or truncated form thereof lacking a C-terminal glycosylphosphatidylinositol (GPI) anchor attachment site or a portion of the GPI anchor attachment site. For example, the hyaluronidase is a PH20 that is a human, monkey, bovine, ovine, rat, mouse or guinea pig PH20. In examples where the hyaluronan-degrading enzyme is a human PH20 hyaluronidase that is neutral active and N-glycosylated the polypeptide is one that is: (a) a hyaluronidase polypeptide that is a full-length PH20 having the sequence of amino acids set forth in SEQ ID NO:2; (b) a C-terminal truncated form of the full-length PH20, wherein the truncated form includes at least amino acid residues 36-464 of SEQ ID NO:1; (c) a hyaluronidase polypeptide having a sequence of amino acids having at least 85%, 86%, 87%, 88%, 89%, 90%, 91%, 92%, 93%, 94%, 95%, 96%, 97%, 98%, 99% or more sequence identity with the polypeptide set forth in (a) or (b); or (c) a hyaluronidase polypeptide of (a) or (b) containing amino acid substitutions, whereby the hyaluronidase polypeptide has a sequence of amino acids having at least 85%, 86%, 87%, 88%, 89%, 90%, 91%, 92%, 93%, 94%, 95%, 96%, 97%, 98%, 99% or more sequence identity with the polypeptide set forth in SEQ ID NO:2 or the with the corresponding truncated forms thereof. For example, the hyaluronidase contains the sequence of amino acids set forth in any of SEQ ID NOS: 4-9, 47, 48, 150-170 and 183-189 or a sequence of amino acids that exhibits at least 85% sequence identity to any of SEQ ID NOS: 4-9, 47, 48, 150-170 and 183-189, such as at least 86%, 87%, 88%, 89%, 90%, 91%, 92%, 93%, 94%, 95%, 96%, 97%, 98%, 99% or more sequence identity to any of SEQ ID NOS: 4-9, 47, 48, 150-170 and 183-189. In particular, the hyaluronidase contains the sequence of amino acids set forth in any of SEQ ID NOS: 4-9, 47, 48, 150-170 and 183-189.

In any of the methods herein, the hyaluronan-degrading enzyme (e.g., hyaluronidase) is administered at or about 10 to 50,000,000 Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 Units. In some cases, the hyaluronan-degrading enzyme is administered in a dosage range amount of between or about between 0.01 µg/kg (body weight of the subject) to 50 µg/kg, 0.01 µg/kg to 20 µg/kg, 0.01 µg/kg to 15 µg/kg, 0.05 µg/kg to 10 µg/kg, 0.75 µg/kg to 7.5 µg/kg or 1.0 µg/kg to 3.0 µg/kg.

In any of the methods herein that include administering an anti-hyaluronan agent (e.g., a hyaluronan-degrading enzyme), the method also can include administering a corticosteroid prior to administration with an anti-hyaluronan agent or after administration with the anti-hyaluronan agent, wherein the corticosteroid is administered in an amount sufficient to ameliorate an adverse effect in the subject from the administered anti-hyaluronan agent. For example, the corticosteroid can be administered at a range between or about between 0.1 to 20 mgs, 0.1 to 15 mgs, 0.1 to 10 mgs, 0.1 to 5 mgs, 0.2 to 20 mgs, 0.2 to 15 mgs, 0.2 to 10 mgs, 0.2 to 5 mgs, 0.4 to 20 mgs, 0.4 to 15 mgs, 0.4 to 10 mgs, 0.4 to 5 mgs, 0.4 to 4 mgs, 1 to 20 mgs, 1 to 15 mgs or 1 to 10 mgs. The corticosteroid can be administered orally.

In any of the methods herein, the hypoxia-activated agent is administered a plurality of times. The hypoxia-activated agent can be administered at a frequency of at least once a day, twice a day, three times a day, four times a day, once a week, twice a week, or once a month for a cycle of administration. In such examples, the cycle of administration is at least three consecutive days, at least a week, at least two week, at least three weeks, at least a month or at least a year. The cycle of administration can continue until a symptom or symptoms of the hypoxia-related disease or condition is ameliorated or reduced.

In any of the methods herein that include administering a second agent in addition to the hypoxia-activated agent, the administration of the second agent and the hypoxia-activated agent are administered in a single composition. In other examples, the second agent and the hypoxia-activated agent are administered separately. In such examples, the second agent and the hypoxia-activated agent are administered simultaneously, sequentially or intermittently in any order. For example, the second agent is administered after administration of the hypoxia-activated agent. The second agent is administered at least 1 hour, 2 hours, 6 hours, 12 hours or 24 hours after administration of the hypoxia-activated agent.

Provided herein is a kit containing: a reagent for detecting a hyaluronan-associated marker; a therapeutically effective amount of a hypoxia-activated agent; and optionally instructions for use of the reagent and/or administration of the hypoxia-activated agent. The kit can further include a device for administration of the hypoxia-activated agent. In examples of the kits herein, the hyaluronan-associated marker is hyaluronan (HA), a hyaluronidase or other hyaluronan-degrading enzyme or a hyaluronan synthase. For example, the hyaluronan-associated marker is hyaluronan (HA). The reagent for detecting hyaluronan is a hyaluronan-associated binding protein (HABP). Included among the HABPs in the kits herein are any HABP described elsewhere herein in this application. In any of the examples of kits herein, the hypoxia-activated agent is a hypoxia-activated prodrug. Included among the hypoxia-activated prodrug in the kits herein are any hypoxia-activated prodrug described elsewhere herein in this application.

Also provided herein are methods of monitoring efficacy of treatment of a hyaluronan-associated disease or condition with an anti-hyaluronan agent that includes the steps of a) identifying a subject that has been treated with an anti-hyaluronan agent; b) assessing the level or amount of hypoxia in a sample from the subject using a hypoxia-detecting marker; and c) comparing the level or amount of hypoxia in the sample to a control, wherein a reduction in hypoxia compared to the control is associated with response to the anti-hyaluronan agent. In such a method, the method can further include step d) if the treatment is not efficacious, altering the treatment.

In any of the monitoring methods herein, the hyaluronan-associated disease or condition is a cancer or a tumor. For example, the disease or condition can be a tumor that is a solid tumor. The disease or condition can be a cancer selected from among any one or more of a late-stage cancer, a metastatic cancer and an undifferentiated cancer. In particular examples, the disease or condition is cancer selected from among any one or more of breast cancer, pancreatic cancer, ovarian cancer, colon cancer, lung cancer, non-small cell lung cancer, in situ carcinoma (ISC), squamous cell carcinoma (SCC), thyroid cancer, cervical cancer, uterine cancer, prostate cancer, testicular cancer, brain cancer, bladder cancer, stomach cancer, hepatoma, melanoma, glioma, retinoblastoma, mesothelioma, myeloma, lymphoma, and leukemia.

In any of the monitoring methods herein, the control is the level or amount of hypoxia in an analogous sample from a healthy population of subjects. In other examples, the control is the level or amount of hypoxia in an analogous sample from the subject prior to treatment with the anti-hyaluronan agent. In other examples, the control is the level or amount of hypoxia in an analogous sample from the subject after the previous dosing or dosage cycle of administration.

In any of the monitoring methods provided herein, the hypoxia-detecting marker is detectably labeled. For example, the detectable label is a radioisotope, bioluminescent compound, chemiluminescent compound, fluorescent compound, metal chelate or enzyme. In any of the methods herein, the hypoxia-detecting marker is a nitroimidazole compound. For example, the hypoxia-detecting marker is selected from among [$^{18}$F]-fluoromisonidazole ([$^{18}$F]-F-MISO), [$^{18}$F]-EF1, [$^{18}$F]-EF3, [$^{18}$9-EF5, [$^{18}$F]FRP-170, [$^{62}$Cu]-ATSM, [$^{60}$Cu]-ATSM, [$^{18}$F]FAZA, [$^{18}$F]HX4, $^{68}$Ga-NOTA-NI, $^{68}$Ga-SCN-NOTA-NI and $^{124}$I-iodoazomycin arabinoside.

In any examples of the monitoring methods provided herein, the hypoxia-detecting marker is detected by a solid phase binding assay, histochemistry or in vivo imaging. In particular examples, the hypoxia-detecting marker labeled with a radionuclide and is detected by in vivo imaging and the in vivo imaging method is single-photon emission computed tomography (SPECT) or positron emission tomography (PET).

In any of the monitoring methods provided herein, the treatment is efficacious if the tumor to background (T/B) ratio is decreased at least 1%, at least 2%, at least 5%, at least 7.5%, at least 10%, at least 15%, at least 20%, at least 25%, at least 30%, at least 40%, at least 50%, at least 75%, or more compared to the control. In other examples of any of the monitoring methods provided herein, the treatment is efficacious if the oxygen partial pressure is increased by at least 1%, at least 2%, at least 5%, at least 7.5%, at least 10%, at least 15%, at least 20%, at least 25%, at least 30%, at least 40%, at least 50%, at least 75%, at least 80%, at least 90%, or more compared to the control. In other examples of any of the monitoring methods herein, the treatment is efficacious if the hypoxic fraction of the tumor is decreased by at least 1%, at least 2%, at least 5%, at least 7.5%, at least 10%, at least 15%, at least 20%, at least 25%, at least 30%, at least 40%, at least 50%, at least 76%, at least 80%, at least 90%, or more compared to the control.

In any of the monitoring methods provided herein, the sample is a stromal tissue sample. For example, the stromal tissue sample is a tumor. The hypoxia-detecting marker can be detected in vivo or ex vivo. For example, in methods using imaging, the hypoxia-detecting marker is administered to the subject, and is detected in the sample in vivo, for example, using imaging methods such as SPECT or PET. In other examples, the hypoxia-detecting marker is detected ex vivo in a sample obtained from a subject. For example, the sample can be a biopsy sample, such as a tumor biopsy. The hypoxia-detecting markers can be detected by histochemistry methods. In other examples, the sample is a fluid sample.

In any of the monitoring methods provided herein, the anti-hyaluronan agent is a hyaluronan degrading enzyme. The hyaluronan degrading enzyme can be modified by conjugation to a polymer. For example, the polymer is PEG and the hyaluronan degrading enzyme is PEGylated. In some examples, the hyaluronan-degrading enzyme is a hyaluronidase. In examples, the hyaluronan-degrading enzyme is a human PH20 hyaluronidase that is neutral active and N-glycosylated and is selected from among a hyaluronidase having the sequence of amino acids set forth in any of SEQ ID NOS: 4-9, 47, 48, 150-170 and 183-189 or a sequence of amino acids that exhibits at least 85% sequence identity to any of SEQ ID NOS: 4-9, 47, 48, 150-170 and 183-189, such as at least 86%, 87%, 88%, 89%, 90%, 91%, 92%, 93%, 94%, 95%, 96%, 97%, 98%, 99% or more sequence identity to any of SEQ ID NOS: 4-9, 47, 48, 150-170 and 183-189.

DETAILED DESCRIPTION

Outline
  A. Definitions
  B. Hypoxia and Hyaluronan and Related Agents and Markers for Treatment
    1. Hypoxia and Related Diseases and Conditions
    2. Hyaluronan and Related Diseases and Conditions
    3. Hyaluronan and/or Hypoxia as Therapeutic Markers
  C. Methods of Diagnosis and Prognosis of Hypoxic Diseases and Conditions Using a Hyaluronan-Associated Marker
    1. Hyaluronan-Associated Markers and Assays to Detect or Assess Hyaluronan-Associated Markers
      Assays for Measuring Hyaluronan
        i. Histochemical and Immunohistochemical Methods
        ii. Solid Phase Binding Assays
        iii. In vivo Imaging Assays
    2. Classification of Subjects
  D. Hyaluronan Binding Proteins (HABPs) for Use as a Diagnostic of Hypoxia
    1. HA Binding Proteins with Link Modules or G1 domains
      a. Type A: TSG-6 sub-group
        i. TSG-6
        ii. Stabilin-1 and Stabilin-2
      b. Type B: CD44 sub-group
        i. CD44
        ii. LYVE-1
      c. Type C: Link Protein Sub-group
        i. HAPLN/Link Protein Family
          1) HAPLN1
          2) HAPLN2
          3) HAPLN3
          4) HAPLN4
          5) Aggrecan 6) Brevican
7) Versican
8) Neurocan
9) Phosphacan
2. HA Binding Proteins Without Link Modules
  a. HABP1/C1QBP
  b. Layilin
  c. RHAMM
  d. Others
3. Modifications of HA Binding Proteins
  a. Multimers of HABP
    i. Peptide Linkers
    ii. Heterobifunctional Linking Agents
    iii. Polypeptide Multimerization Domains
      1) Immunoglobulin Domain Fc Domain
      2) Leucine Zipper
      3) Protein-Protein Interaction Between Subunits
      4) Other Multimerization domains
  b. Mutations to Improve HA Binding
  c. Modifications of HA Binding Proteins for Detection
    i. Conjugation to Detectable Proteins or Moieties
4. Selection of HA Binding Proteins for Diagnostic Use
E. Hypoxia-Activated Agents and Treatment with Hypoxia-Activated Agents
1. Bioreductive Anticancer Agents
  a. Aromatic N-oxides
    i. Tirapazamine
    ii. CEN-209
  b. Quinone
    i. Mitomycin C (MMC)
    ii. Porfiromycin (PM)
    iii. EO9 (Apaziquone)
    iv. RH1
    v. Cyclopropamitosenes
  c. Tertiary amine N-oxides
    i. AQ4N
  d. Nitro
    i. CB1954 and Analogs
    ii. N—[(N,N-dimethylamino)ethyl]carboxamide derivatives
    iii. PR-104 and related molecules
    iv. Nitrobenzindoles
    v. 1,2-bis(sulfonyl)hydrazine prodrugs (SHPs) (e.g., KS119 and analogs)
    vi. NLCQ-1
  f. Transition metal-containing hypoxia-activated agent
2. Prodrugs of Anti-Neoplastic Agents
  a. Phosphoramidate Alkylator Prodrugs
    i. TH-281
    ii. TH-302
  b. Camptothecin Prodrug Derivatives
  c. Pan-Her Inhibitor Prodrug
3. Conjugates
4. Dosages and Administration
F. Anti-Hyaluronan Agent Therapy
1. Agents that Inhibit Hyaluronan Synthesis
2. Hyaluronan-Degrading Enzyme
  a. Hyaluronidases
    i. Mammalian-Type Hyaluronidases PH20
    ii. Other Hyaluronidases
    b. Other Hyaluronan-Degrading Enzymes
    c. Soluble Hyaluronan-Degrading Enzymes
      i. Soluble Human PH20
    d. Glycosylation of Hyaluronan-Degrading Enzymes
    e. Modified (Polymer-Conjugated) Hyaluronan-Degrading Enzymes
G. Monitoring Therapies
  1. Hypoxia-Detecting Agents
  2. Hyaluronan-Associated Markers
  3. Other Monitoring Methods
    a. Assays to Assess Enzyme Activity
    b. Measurement of HA catabolites
    c. Tumor metabolic activity
    d. Increased apparent diffusion and enhanced tumor perfusion
    e. Tumor size and volume
    f. Health of Subject
H. Methods of Producing Nucleic Acids and Encoded Polypeptides
  1. Vectors and Cells
  2. Expression
    a. Prokaryotic Cells
    b. Yeast Cells
    c. Insect Cells
    d. Mammalian cells
    e. Plants
  3. Purification Techniques
I. Formulations And Articles of Manufacture
  1. Pharmaceutical Compositions and Formulations
    a. Compositions of a Hypoxia-activated agent
    b. Composition of an Anti-Hyaluronan agent
  2. Delivery Methods
  3. Packaging and Articles of Manufacture
J. Methods of Treatment of Hypoxia-Related Conditions or Hyaluronan-Associated Diseases and Conditions
  1. Cancers
  2. Dosages for Administration
    a. Hypoxia-activated Agent
    b. Anti-Hyaluronan Agent
  3. Combination Therapy
    a. Anti-Cancer Agents and Other Treatments
    b. Corticosteroid
K. Examples

A. DEFINITIONS

Unless defined otherwise, all technical and scientific terms used herein have the same meaning as is commonly understood by one of skill in the art to which the invention(s) belongs/belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it is understood that such identifiers can change and particular information on the internet can come and go, but equivalent information can be found by searching the internet. Reference thereto evidences the availability and public dissemination of such information.

As used herein, "hypoxia" (or "hypoxic") refers to an environment of oxygen deficiency or inadequate oxygen supply below physiological levels, such that the oxygen content ($O_2$) is less than or equal to about 5%. In most cases, hypoxic tissue will have an oxygen content that is less than or equal to about 2% or less. Hypoxia can be associated with low $O_2$ partial pressure ($pO_2$) less than 20 mm of mercury [mmHg], such as less than 15 mmHg, less than 10 mmHg, less than 5.0 mmHg or less.

As used herein, "normoxic" or "oxic" conditions are conditions having a normal level of oxygen for that particular environment. Normoxic or oxic tissue typically has an oxygen content above or greater than about 5%, about 10%, about 15%, about 20% or greater. Tissue normoxia is generally associated with an $O_2$ partial pressure ($pO_2$) of greater than 20 mm mercury [mmHg], such as greater than 30 mmHg or greater than 40 mmHg, and generally between or about between 20-40 mmHg.

As used herein, a "hypoxia-related condition" in an animal is a condition where hypoxia in a tissue of the animal is involved. The hypoxia can either be a symptom or play a role in the cause, development, progression, amelioration, or cure of the condition. A hypoxia-related condition can be a disease or pathological condition. Hypoxia-related conditions include, but are not limited to, cancer, ischemia, reperfusion, retinopathy, neonatal distress, preeclampsia, cardiac arrest, stroke, and wound healing. Such conditions include hyperproliferative diseases and conditions.

As used herein, a hypoxia-activated agent is an drug or agent that is specifically active in a hypoxic microenvironment, including hypoxic zones of solid tumors. Thus, the hypoxia-activated agent is only active under hypoxic conditions or in hypoxic environments.

As used herein, a "prodrug" refers to a compound that exhibits pharmacologic activity after biotransformation. For example, a prodrug is a compound that, after administration, is metabolized or otherwise converted to a biologically active or more active compound (or drug) with respect to at least one property. A prodrug, relative to the drug, is modified chemically in a manner that renders it, relative to the drug, less active or inactive, but the chemical modification is such that the corresponding drug is generated by metabolic or other biological processes after the prodrug is administered. A prodrug can have, relative to the active drug, altered metabolic stability or transport characteristics, fewer side effects or lower toxicity, or improved flavor (for example, see the reference Nogrady, 1985, Medicinal Chemistry A Biochemical Approach, Oxford University Press, New York, pages 388-392).

As used herein, a bioreductive group or bioreducible group refers to chemical moieties that are reducible by endogenous reductase enzymes that effect one-electron or two-electron reduction, such as P450 reductase and cytochrome P450s. Examples of bioreductive groups include, for example, quinones, N-oxides, aromatic nitro groups and other groups as described herein.

As used herein, "Hypoxia activated prodrug" or "HAP" refers to a prodrug wherein the prodrug is less active or inactive, relative to the corresponding drug, and is only converted to an active drug in a hypoxic environment, such as the hypoxic environment of a tumor tissue. For example, HAPS can contain the drug and one or more bioreducible groups. HAPs include prodrugs that are activated by a variety of reducing agents and reducing enzymes, including without limitation single electron transferring enzymes (such as cytochrome P450 reductases) and two electron transferring (or hydride transferring) enzymes. Such prodrugs contain an active agent (e.g., an anti-neoplastic agent) that is protected or masked by a bioreductive group (e.g., nitroheterocyclic group) whereby reduction of a bioreductive group triggers activation or release of the active agent, such as the neoplastic or other anti-cancer agent that exhibits cytotoxic activity. Exemplary HAPs are described herein and known in the art (see e.g., International PCT Publication Nos. WO 00/064864, WO 05/087075, WO 07/002931, WO 08/083101; US Pat Publ. Nos. US2007/0032455, US2005/0256191, US2007/0032455 and US2009/0136521 and other references cited herein).

As used herein, a pan-Her inhibitor refers to an agent that inhibits one or more Her-family receptors, such as Her1, Her2, Her3 and EGFR. Prodrugs of pan-Her inhibitors include those in which the pan-Her inhibitor is only active in the hypoxic condition of the tumor.

As used herein, a derivative refers to a form of a drug that has undergone change or modification from a reference drug or agent, but still retains activity (e.g., exhibits increased or decreased activity) compared to the reference drug or agent. Typically a derivative form of a compound means that a side chain of the compound has been modified or changed.

As used herein, an analogue or analog of a drug or agent is a drug or agent that is related to a reference drug, but whose chemical and biological activities can be different. Typically, analogues exhibit similar activities to a reference drug or agent, but the activity can be increased or decreased or otherwise improved. Typically, an analogue form of a compound or drug means that the backbone core of the structure is modified or changed compared to a reference drug.

As used herein, a companion diagnostic or diagnostic refers to a diagnostic method and or reagent that is used to identify subjects susceptible to treatment with a particular treatment or to monitor treatment and/or to identify an effective dosage for a subject or sub-group or other group of subjects. For purposes herein, a companion diagnostic refers to reagents, such as modified TSG-6 proteins, that are used to detect hyaluronan in a sample. The companion diagnostic refers to the reagents and also to the test(s) that is/are performed with the reagent. The diagnostics can be used to identify or select subjects susceptible to treatment with a hypoxia-activated agent.

As used herein, a "hyaluronan-associated marker" refers to any marker that is an indicator of HA levels and/or relative HA levels in a sample. Hence, hyaluronan is a hyaluronan-associated marker. Such markers also include any protein or nucleic acid molecule encoding a protein involved in the synthesis or degradation of hyaluronan. Exemplary of such other markers are hyaluronan synthases or hyaluronan-degrading enzymes (e.g., hyaluronidases).

As used herein, a hyaluronidase substrate refers to a substrate (e.g., protein or polysaccharide) that is cleaved and/or depolymerized by a hyaluronidase enzyme. Generally, a hyaluronidase substrate is a glycosaminoglycan. An exemplary hyaluronidase substrate is hyaluronan (HA).

As used herein, hyaluronan (HA; also known as hyaluronic acid or hyaluronate) refers to a naturally occurring polymer of repeated disaccharide units of N-acetylglucosamine and D-glucuronic acid. Hyaluronan is produced by certain tumors.

As used herein, "high HA" with reference to the amount or level of HA in a tissue or body fluid sample refers to the degree or extent of HA in the tissue or body fluid sample as compared to a normal or healthy tissue or body fluid sample. The amount of HA is high if the amount is at least or at least about 2.5-fold, 3-fold, 4-fold, 5-fold, 6-fold, 7-fold, 8-fold, 9-fold, 10-fold, 20-fold, 30-fold, 40-fold, 50-fold, 60-fold, 70-fold or higher than the amount or level of HA in a corresponding normal or healthy tissue. It is understood that the amount of HA can be determined and quantitated or semi-quantitated using methods such as solid-phase binding assays or histochemistry. For example, the amount can be based on comparison of plasma levels or comparison of staining intensity (e.g., percent positive pixels) as determined by histochemistry. For example, high HA exists if the HA score by histochemistry or other method is $HA^{+3}$ and/or if there is HA staining over 25% of tumor section. For example, high HA exists if there is a ratio of strong positive stain (such as brown stain) to the sum of total stained area that is more than 25% strong positive stain to total stain the tumor tissue.

As used herein, elevated HA in a sample refers to an amount of HA in a sample that is increased compared to the level present in a corresponding sample from a healthy sample or compared to a predetermined standard. For example, elevated hyaluronan levels refers to amounts of hyaluronan in particular tissue, body fluid or cell, dependent upon the disease or condition, as a consequence of or otherwise observed in the disease. For example, as a consequence of the presence of a hyaluronan-rich tumor, hyaluronan (HA) levels can be elevated in body fluids, such as blood, urine, saliva and serum, and/or in the tumorous tissue or cell. The level can be compared to a standard or other suitable control, such as a comparable sample from a subject who does not have the HA-associated disease, such as a subject that does not have a tumor. In some cases, elevated levels can refer to high HA levels.

As used herein, elevated level refers to the any level or amount of above a recited or normal threshold.

As used herein, normal levels or values can be defined in a variety of ways known to one of skill in the art. Typically, normal levels refer to the levels of an HA across a healthy population. The normal levels (or reference levels) are based on measurements of healthy subjects, such as from a specified source (i.e., blood, serum, tissue, or other source). Often, a normal level will be specified as a "normal range", which typically refers to the range of values of the median 95% of the healthy population. Reference value is used interchangeably herein with normal level but can be different from normal levels depending on the subjects or the source. Reference levels are typically dependent on the normal levels of a particular segment of the population. Thus, for purposes herein, a normal or reference level is a predetermined standard or control by which a test patient can be compared.

As used herein, an HA score refers to a semi-quantitative score of HA positivity levels on cell members and stroma of tumors. The score can be determined by detection of HA in tumor tissue, such as formalin-fixed and paraffin-embedded tissue, by histochemistry methods, such as immunohistochemistry or pseudo immunohistochemistry methods, for HA using an HABP. The degree of stain on cells and stroma can be determined visually under a microscope or by available computer algorithm programs and software. For example, images can be quantitatively analyzed using a pixel count algorithm for HA stain (e.g., Aperio Spectrum Software and other standard methods that measure or quantitate or semi-quantitate the degree of staining). A tumor is graded or scored as $HA^{High}$ at strong HA staining over 25% of tumor section; as $HA^{Moderate}$ at strong HA staining between 10 and 25% of tumor section; and as $HA^{Low}$ at strong HA staining under 10% of tumor section. For example, a ratio of strong positive stain (such as brown stain) to the sum of total stained area can be calculated and scored, where if the ratio is more than 25% strong positive stain to total stain the tumor tissue is scored as $HA^{+3}$, if the ratio is 10-25% of strong positive stain to total stain the tumor tissue is scored as $HA^{+2}$, if the ratio less than 10% of strong positive stain to total stain the tumor tissue is scored as $HA^{+1}$, and if the ratio of strong positive stain to total stain is 0 the tumor tissue is scored as 0. The Aperio method, as well as software therefor, are known to those of skill in the art (see, e.g., U.S. Pat. No. 8,023,714; U.S. Pat. No. 7,257,268).

As used herein, a hyaluronan binding protein (HA binding protein; HABP) or hyaladherin refers to any protein that specifically binds to HA to permit detection of the HA. The binding affinity as an association constant Ka is at least about or is at least $10^7 M^{-1}$. For the methods and companion diagnostic products provided herein, the HA binding protein is a recombinantly produced or synthetic protein(s), not a protein derived from a biological source or physiologic source, such a bone cartilage. HA binding proteins include HA binding domains, including link modules that bind to HA and sufficient portions thereof that specifically bind to HA to permit detection thereof. Hence, HABPs include any protein that contains a hyaluronan binding region or a sufficient portion thereof to specifically bind HA. Exemplary hyaluronan binding regions are link modules (link domains) or G1 domains. A sufficient portion includes at least 10, 20, 30, 40, 50, 60, 70, 80, 90, 95 or more contiguous amino acids of a binding domain or link module. HA binding proteins also include fusion proteins containing an HA binding protein and one or more additional polypeptides, including multimerization domains. Exemplary HA binding proteins include, but are not limited to aggrecan, versican, neurocan, brevican, phosphacan, TSG-6, TSG-6 mutants, such as those provided herein, including polypeptides containing HA binding domains and link modules thereof that bind to HA.

As used herein, reference that "the only portion of an HABP" is a link module or G1 domain or grammatical variations thereof means that the HABP molecule consists or consists essentially of the link module or G1 domain but does not include the complete full-length sequence of amino acids of the reference HABP. Hence, the HABP only contains a hyaluronan-binding region or a sufficient portion thereof to specifically bind to HA. It is understood that the HABP can contain additional non-HABP amino acid sequences, including but not limited to, sequences that correspond to a detectable moiety or moiety capable of detection or a multimerization domain.

As used herein, modified, with respect to modified HA binding proteins refers to modifications to alter, typically improve, one more properties of an HA binding protein for detection in the diagnostic methods provided herein. Modifications include mutations that increase affinity and/or specificity of the protein for HA.

As used herein, a domain refers to a portion (a sequence of three or more, generally 5 or 7 or more amino acids) of a polypeptide that is a structurally and/or functionally distinguishable or definable. For example, a domain includes those that can form an independently folded structure within a protein made up of one or more structural motifs (e.g., combinations of alpha helices and/or beta strands connected by loop regions) and/or that is recognized by virtue of a functional activity, such as kinase activity. A protein can have one, or more than one, distinct domain. For example, a domain can be identified, defined or distinguished by homology of the sequence therein to related family members, such as homology and motifs that define an extracellular domain. In another example, a domain can be distinguished by its function, such as by enzymatic activity, e.g., kinase activity, or an ability to interact with a biomolecule, such as DNA binding, ligand binding, and dimerization. A domain independently can exhibit a function or activity such that the domain independently or fused to another molecule can perform an activity, such as, for example proteolytic activity or ligand binding. A domain can be a linear sequence of amino acids or a non-linear sequence of amino acids from the polypeptide. Many polypeptides contain a plurality of domains.

As used herein, a "G1 domain" refers to an HA binding domain of a Type C HA binding protein. The G1 domain contains an Ig module and two link modules. Exemplary proteins that contain a G1 domain include Hyaluronan and Proteoglycan Link Protein 1 (HAPLN1)/link protein, HAPLN2, HAPLN3, HAPLN4, aggrecan, versican, brevican, neurocan and phosphacan.

As used herein, link modules or link domain, used interchangeably herein, are hyaluronan-binding domains that occur in proteins that are involved in the assembly of extracellular matrix, cell adhesion and migration. For example, the link module from human TSG-6 contains two alpha helices and two antiparallel beta sheets arranged around a hydrophobic core. This defines the consensus fold for the Link module superfamily, which includes CD44, cartilage link protein and aggrecan.

As used herein, an "Ig module" refers to the portion of the G1 domain of Type C HABPs that is involved in the binding between Type C HABPs. Ig modules of Type C hyaluronans interact with one another to form a stable tertiary structure with hyaluronan.

As used herein, a fusion protein refers to a chimeric protein containing two or more portions from two more proteins or peptides that are linked directly or indirectly via peptide bonds. For example, a fusion protein can include a polypeptide encoded by a nucleic acid sequence containing a coding sequence from one nucleic acid molecule and the coding sequence from another nucleic acid molecule in which the coding sequences are in the same reading frame such that when the fusion construct is transcribed and translated in a host cell, the protein is produced containing the two proteins. The two molecules can be adjacent in the construct or separated by a linker polypeptide that contains, 1, 2, 3, or more, but typically fewer than 10, 9, 8, 7, or 6 amino acids. The protein product encoded by a fusion construct is referred to as a fusion polypeptide.

As used herein, a multimerization domain refers to a sequence of amino acids that promotes stable interaction of a polypeptide molecule with another polypeptide molecule containing a complementary multimerization domain, which can be the same or a different multimerization domain to form a stable multimer with the first domains. Generally, a polypeptide is joined directly or indirectly to the multimerization domain. Exemplary multimerization domains include the immunoglobulin sequences or portions thereof, leucine zippers, hydrophobic regions, hydrophilic regions, compatible protein-protein interaction domains such as, but not limited to an R subunit of PKA and an anchoring domain (AD), a free thiol that forms an intermolecular disulfide bond between two molecules, and a protuberance-into-cavity (i.e., knob into hole) and a compensatory cavity of identical or similar size that form stable multimers. The multimerization domain, for example, can be an immunoglobulin constant region. The immunoglobulin sequence can be an immunoglobulin constant domain, such as the Fc domain or portions thereof from IgG1, IgG2, IgG3 or IgG4 subtypes, IgA, IgE, IgD and IgM.

As used herein, "knobs into holes" (also referred to herein as protuberance-into-cavity) refers to particular multimerization domains engineered such that steric interactions between and/or among such domains, not only promote stable interaction, but also promote the formation of heterodimers (or multimers) over homodimers (or homomultimers) from a mixture of monomers. This can be achieved, for example by constructing protuberances and cavities. Protuberances can be constructed by replacing small amino acid side chains from the interface of the first polypeptide with larger side chains (e.g., tyrosine or tryptophan). Compensatory "cavities" of identical or similar size to the protuberances optionally are created on the interface of a second polypeptide by replacing large amino acid side chains with smaller ones (e.g., alanine or threonine).

As used herein, complementary multimerization domains refer to two or more multimerization domains that interact to form a stable multimers of polypeptides linked to each such domain. Complementary multimerization domains can be the same domain or a member of a family of domains, such as for example, Fc regions, leucine zippers, and knobs and holes.

As used herein, "Fc" or "Fc region" or "Fc domain" refers to a polypeptide containing the constant region of an antibody heavy chain, excluding the first constant region immunoglobulin domain. Thus, Fc refers to the last two constant region immunoglobulin domains of IgA, IgD, and IgE, or the last three constant region immunoglobulin domains of IgE and IgM. Optionally, an Fc domain can include all or part of the flexible hinge N-terminal to these domains. For IgA and IgM, Fc can include the J chain. An exemplary Fc domain of IgG contains immunoglobulin domains $C\gamma 2$ and $C\gamma 3$, and optionally all or part of the hinge between $C\gamma 1$ and $C\gamma 2$. The boundaries of the Fc region can vary, but typically, include at least part of the hinge region. In addition, Fc also includes any allelic or species variant or any variant or modified form, such as any variant or modified form that alters the binding to an FcR or alters an Fc-mediated effector function. Exemplary sequences of other Fc domains, including modified Fc domains are known.

As used herein, "Fc chimera" refers to a chimeric polypeptide in which one or more polypeptides is linked, directly or indirectly, to an Fc region or a derivative thereof. Typically, an Fc chimera combines the Fc region of an immunoglobulin with another polypeptide. Derivatives of or modified Fc polypeptides are known to those of skill in the art.

As used herein, "multimer" with reference to a hyaluronan binding protein refers to an HABP that contains multiple HA binding sites, for example, at least 2, 3, or 4 HA binding sites. For example, an HABP multimer refers to an HABP that contains at least 2 link modules that are each capable of binding to HA. For example, a multimer can be generated by linking, directly or indirectly, two or more link modules (e.g., TSG-6 link module). The linkage can be facilitated using a multimerization domain, such as an Fc protein.

As used herein, an allelic variant or allelic variation refers to a polypeptide encoded by a gene that differs from a reference form of a gene (i.e., is encoded by an allele). Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% or greater identity with a wildtype and/or predominant form, including 96%, 97%, 98%, 99% or greater identity with a wildtype and/or predominant form of a polypeptide.

As used herein, species variants refer to variants of the same polypeptide between and among species. Generally, interspecies variants have at least about 60%, 70%, 80%, 85%, 90%, or 95% or greater identity with a wildtype and/or predominant form from another species, including 96%, 97%, 98%, 99% or greater identity with a wildtype and/or predominant form of a polypeptide.

As used herein, "nucleic acids" include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is greater than or equal to 2 amino acids in length, and less than or equal to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, the "naturally occurring α-amino acids" are the residues of those 20 α-amino acids found in nature which are incorporated into protein by the specific recognition of the charged tRNA molecule with its cognate mRNA codon in humans. Non-naturally occurring amino acids thus include, for example, amino acids or analogs of amino acids other than the 20 naturally-occurring amino acids and include, but are not limited to, the D-stereoisomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g., Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carrillo, H. & Lipman, D., SIAM J Applied Math 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; Carrillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12 (I):387 (1984)), BLASTP, BLASTN, FASTA (Altschul, S. F., et al., *J Mol Biol* 215:403 (1990)); Guide to Huge Computers, Martin J. Bishop, ed., Academic Press, San Diego, 1994, and Carrillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) J. Mol. Biol. 48:443, as revised by Smith and Waterman (1981) Adv. Appl. Math. 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., ATLAS OF PROTEIN SEQUENCE AND STRUCTURE, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differ from those of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the complement of the 5' end of a sequence to be amplified (e.g., by PCR) and a 3' (downstream) primer that hybridizes with the 3' end of the sequence to be amplified.

As used herein, "specifically hybridizes" refers to annealing, by complementary base-pairing, of a nucleic acid molecule (e.g., an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, modification in reference to modification of a sequence of amino acids of a polypeptide or a sequence of nucleotides in a nucleic acid molecule and includes deletions, insertions, and replacements of amino acids and nucleotides, respectively. Exemplary of modifications are amino acid substitutions. An amino-acid substituted polypeptide can exhibit 65%, 70%, 80%, 85%, 90%, 91%, 92%, 93%, 94%, 95%, 96%, 97%, 98% or more sequence identity to a polypeptide not containing the amino acid substitutions. Amino acid substitutions can be conservative or non-conservative. Generally, any modification to a polypeptide retains an activity of the polypeptide. Methods of modifying a polypeptide are routine to those of skill in the art, such as by using recombinant DNA methodologies.

As used herein, corresponding residues refers to residues that occur at aligned loci. Related or variant polypeptides are aligned by any method known to those of skill in the art. Such methods typically maximize matches, and include methods such as using manual alignments and by using the numerous alignment programs available (for example, BLASTP) and others known to those of skill in the art. By aligning the sequences of polypeptides, one skilled in the art can identify corresponding residues, using conserved and identical amino acid residues as guides. Corresponding positions also can be based on structural alignments, for example by using computer simulated alignments of protein structure. In other instances, corresponding regions can be identified.

As used herein, suitable conservative substitutions of amino acids are known to those of skill in the art and can be made generally without altering the biological activity of the resulting molecule. Those of skill in the art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in TABLE 2 as follows:

TABLE 2

| Original residue | Exemplary conservative substitution |
|---|---|
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

Hence, reference to a substantially purified polypeptide, such as a substantially purified soluble PH20, refers to preparations of proteins that are substantially free of cellular material includes preparations of proteins in which the protein is separated from cellular components of the cells from which it is isolated or recombinantly-produced. In one embodiment, the term substantially free of cellular material includes preparations of enzyme proteins having less than about 30% (by dry weight) of non-enzyme proteins (also referred to herein as a contaminating protein), generally less than about 20% of non-enzyme proteins or 10% of non-enzyme proteins or less than about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means or using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, "operably" or "operatively linked" when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein the term "assessing" is intended to include quantitative and qualitative determination in the sense of obtaining an absolute value for the activity of a protein, such as an enzyme, or a domain thereof, present in the sample, and also of obtaining an index, ratio, percentage, visual or other value indicative of the level of the activity. Assessment can be direct or indirect. For example, the chemical species actually detected need not of course be the enzymatically cleaved product itself but can for example be a derivative thereof or some further substance. For example, detection of a cleavage product can be a detectable moiety such as a fluorescent moiety.

As used herein, a composition refers to any mixture. It can be a solution, a suspension, liquid, powder, a paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein a kit refers to a combination of components, such as a combination of the compositions herein and another item for a purpose including, but not limited to, reconstitution, activation, and instruments/devices for delivery, administration, diagnosis, and assessment of a biological activity or property. Kits optionally include instructions for use.

As used herein, "sample obtained from a patient" or a "sample obtained from an animal" can be a sample of tissue or a sample of body fluid.

As used herein, a "sample previously obtained from a subject" refers to samples obtained from subjects prior to treatment with an active compound herein, such as with a hypoxia-activated agent.

As used herein, biological sample refers to any sample obtained from a living or viral source or other source of macromolecules and biomolecules, and includes any cell type or tissue of a subject from which nucleic acid or protein or other macromolecule can be obtained. The biological sample can be a sample obtained directly from a biological source or to sample that is processed. For example, isolated nucleic acids that are amplified constitute a biological sample. Biological samples include, but are not limited to, body fluids, such as blood, plasma, serum, cerebrospinal fluid, synovial fluid, urine and sweat, tissue and organ samples from animals, including biopsied tumor samples.

As used herein, "tissue" refers to any biological matter made up of one cell, multiple cells, an agglomeration of cells, or an entire organ. The term tissue encompasses a cell or cells which can be either normal or abnormal (i.e., a tumor).

As used herein, a "body fluid" refers to any liquid substance extracted, excreted, or secreted from an organism or a tissue of an organism. The body fluid need not necessarily contain cells. Body fluids include, but are not limited to, whole blood, serum, plasma, urine, cerebral spinal fluid, tears, and amniotic fluid.

As used herein, detection includes methods that permit visualization (by eye or equipment) of a protein. A protein can be visualized using an antibody specific to the protein. Detection of a protein can also be facilitated by fusion of a protein with a tag including an epitope tag or label.

As used herein, a label refers to a detectable compound or composition which is conjugated directly or indirectly to a polypeptide so as to generate a labeled polypeptide. The label can be detectable by itself (e.g., radioisotope labels or fluorescent labels) or, in the case of an enzymatic label, can catalyze chemical alteration of a substrate compound composition which is detectable. Non-limiting examples of labels included fluorogenic moieties, green fluorescent protein, or luciferase.

As used herein, affinity refers to the strength of interaction between two molecules such as between a hyaluronan binding protein and hyaluronan. Affinity is often measured by equilibrium association constant (Ka) or equilibrium dissociation constant (Kd). The binding affinity between the molecules described herein, typically has a binding affinity represented by the association constant (Ka) of at least about $10^6$ l/mol, $10^7$ l/mol, 108 l/mol, $10^9$ l/mol or greater (generally $10^7$-$10^8$ l/mol or greater). The binding affinity of molecules herein also can be described by the dissociation constant (Kd) of less than or $10^{-7}$ M, $10^{-8}$ M, $10^{19}$ M, $10^{-10}$ M, $10^{-11}$ M, $10^{-12}$ M or lower.

As used herein, reference to a sufficient portion thereof that binds to hyaluronan (HA) means that the binding molecule exhibits a Ka of at least or at least about $10^7$ to $10^8$ M$^{-1}$ or a dissociation constant (Kd) of $1\times10^{-7}$ M or $1\times10^{-8}$ M or less to HA.

As used herein, specificity (also referred to herein as selectively) with respect to two molecules, such as with respect to a hyaluronan binding protein and HA, refers to the greater affinity the two molecules exhibit for each other compared to the affinity for other molecules. Thus, a hyaluronan binding protein (HABP) with greater specificity for HA means that it binds to other molecules, such as heparin, with lower affinity than it binds to HA. Specific binding typically results in selective binding.

As used herein, a "solid phase binding assay" refers to an in vitro assay in which an antigen is contacted with a ligand, where one of the antigen or ligand are bound to a solid support. The solid phase can be one in which components are physically immobilized to a solid support. For example, solid supports include, but are not limited to, a microliter plate, a membrane (e.g., nitrocellulose), a bead, a dipstick, a thin-layer chromatographic plate, or other solid medium. Upon antigen-ligand interaction, the unwanted or non-specific components can be removed (e.g., by washing) and the antigen-ligand complex detected.

As used herein, predicting efficacy of treatment with an anti-hyaluronan agent, such as a hyaluronan-degrading enzyme, means that the companion diagnostic can be a prognostic indicator of treatment with an anti-hyaluronan agent, such as a hyaluronan degrading enzyme. For example, based on the results of detection of hyaluronan or other marker with the companion diagnostic, it can be determined that an anti-hyaluronan agent, such as a hyaluronan-degrading enzyme, will likely have some effect in treating subject.

As used herein, a prognostic indicator refers to a parameter that indicates the probability of a particular outcome, such as the probability that a treatment will be effective for a particular disease or subject.

As used herein, a hypoxia-detecting agent or marker refers to any agent that facilitates, directly or indirectly, the assessment, measurement or determination of the inadequate oxygen content or reduced partial pressure in a cell or tissue that occurs under hypoxic conditions. The agent can directly monitor or detect the oxygen levels, and hence can be an oxygen sensor. In other cases, the agent is one that is altered, chemically or structurally, by changes in oxygen content, whereby the alteration facilitates the assessment, measurement or determination of oxygen content or reduced partial pressure. For example, hypoxia-detecting agents include agents that form adducts or are trapped in hypoxic cells and tissues only under conditions of low oxygen content. Exemplary of such agents include nitroimidazoles, and particularly 2-nitroimidazoles. Such agents are known to the skilled artisan, and non-limiting examples are described herein (e.g., pimonidazole (Hypoxyprobe™), [$^{18}$F]FAZA, [$^{18}$F]HX4, [$^{64}$Cu]ATSM and others described herein and known in the art). In further cases, the agent is one that detects a response to a hypoxic condition, such as changes (e.g., increase or decrease) in the expression or level of a gene. For example, the agent can detect increases or overexpression of hypoxia markers such as, but not limited to, hypoxia inducible factor (HIF-1), vascular endothelial growth factor (VEFG), metallothionein (MT), glucose transporter-1 (Glut-1), or carbonic anhydrase IX (CAIX). In any of the above examples, the agent can be detectably labeled in order to facilitate detection in a sample in vitro, ex vivo or in vivo (e.g., by imaging techniques).

As used herein, an anti-hyaluronan agent refers to any agent that modulates hyaluronan (HA) synthesis or degradation, thereby altering hyaluronan levels in a tissue or cell. For purposes herein, anti-hyaluronan agents reduce hyaluronan levels in a tissue or cell compared to the absence of the agent. Such agents include compounds that modulate the expression of genetic material encoding HA synthase (HAS) and other enzymes or receptors involved in hyaluronan metabolism, or that modulate the proteins that synthesize or degrade hyaluronan including HAS function or activity. The agents include small-molecules, nucleic acids, peptides, proteins or other compounds. For example, anti-hyaluronan agents include, but are not limited to, antisense or sense molecules, antibodies, enzymes, small molecule inhibitors and HAS substrate analogs.

As used herein, a hyaluronan-degrading enzyme refers to an enzyme that catalyzes the cleavage of a hyaluronan polymer (also referred to as hyaluronic acid or HA) into smaller molecular weight fragments. Exemplary of hyaluronan-degrading enzymes are hyaluronidases, and particular chondroitinases and lyases that have the ability to depolymerize hyaluronan. Exemplary chondroitinases that are hyaluronan-degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase. Chondroitin ABC lyase contains two enzymes, chondroitin-sulfate-ABC endolyase (EC 4.2.2.20) and chondroitin-sulfate-ABC exolyase (EC 4.2.2.21). An exemplary chondroitin-sulfate-ABC endolyases and chondroitin-sulfate-ABC exolyases include, but are not limited to, those from *Proteus vulgaris* and *Pedobacter heparinus* (the *Proteus vulgaris* chondroitin-sulfate-ABC endolyase is set forth in SEQ ID NO:98; Sato et al. (1994) *Appl. Microbiol. Biotechnol.* 41(1):39-46). Exemplary chondroitinase AC enzymes from the bacteria include, but are not limited to, those from *Pedobacter heparinus*, set forth forth in SEQ ID NO:99, *Victivallis vadensis*, set forth in SEQ ID NO:100, and *Arthrobacter aurescens* (Tkalec et al. (2000) *Applied and Environmental Microbiology* 66 (1):29-35; Ernst et al. (1995) *Critical Reviews in Biochemistry and Molecular Biology* 30 (5):387-444). Exemplary chondroitinase C enzymes from the bacteria include, but are not limited to, those from *Streptococcus* and *Flavobacterium* (Hibi et al. (1989) *FEMS-Microbiol-Lett.* 48 (2):121-4; Michelacci et al. (1976) *J Biol. Chem.* 251:1154-8; Tsuda et al. (1999) *Eur. J. Biochem.* 262:127-133).

As used herein, hyaluronidase refers to a class of hyaluronan-degrading enzymes. Hyaluronidases include bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary non-human hyaluronidases include, hyaluronidases from cows (SEQ ID NOS: 10, 11, 64 and BH55 (U.S. Pat. Nos.

5,747,027 and 5,827,721), yellow jacket wasp (SEQ ID NOS: 12 and 13), honey bee (SEQ ID NO:14), white-face hornet (SEQ ID NO:15), paper wasp (SEQ ID NO:16), mouse (SEQ ID NOS: 17-19, 32), pig (SEQ ID NOS: 20-21), rat (SEQ ID NOS: 22-24, 31), rabbit (SEQ ID NO:25), sheep (SEQ ID NOS: 26, 27, 63 and 65), chimpanzee (SEQ ID NO:101), Rhesus monkey (SEQ ID NO:102), orangutan (SEQ ID NO:28), cynomolgus monkey (SEQ ID NO:29), guinea pig (SEQ ID NO:30), *Arthrobacter* sp. (strain FB24 (SEQ ID NO:67)), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); serotype III (SEQ ID NO:73)), *Staphylococcus aureus* (strain COL (SEQ ID NO:74); strain MRSA252 (SEQ ID NOS: 75, 76 and 89); strain MSSA476 (SEQ ID NO:77); strain NCTC 8325 (SEQ ID NO:78); strain bovine RF122 (SEQ ID NOS: 79 and 80); strain USA300 (SEQ ID NO:81)), *Streptococcus pneumoniae* ((SEQ ID NO:82); strain ATCC BAA-255/R6 (SEQ ID NO:83); serotype 2, strain D39/NCTC 7466 (SEQ ID NO:84)), *Streptococcus pyogenes* (serotype M1 (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096; serotype M12, strain MGAS9429 (SEQ ID NOS: 90 and 91); serotype M28 (SEQ ID NO:92)), *Streptococcus suis* (SEQ ID NOS: 93-95); *Vibrio fischeri* (strain ATCC 700601/ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607). Hyaluronidases also include those of human origin. Exemplary human hyaluronidases include HYAL1 (SEQ ID NO:36), HYAL2 (SEQ ID NO:37), HYAL3 (SEQ ID NO:38), HYAL4 (SEQ ID NO:39), and PH20 (SEQ ID NO:1). Also included amongst hyaluronidases are soluble hyaluronidases, including, ovine and bovine PH20, soluble human PH20 and soluble rHuPH20. Examples of commercially available bovine or ovine soluble hyaluronidases include Vitrase® (ovine hyaluronidase), Amphadase® (bovine hyaluronidase) and Hydase™ (bovine hyaluronidase).

As used herein, "purified bovine testicular hyaluronidase" refers to a bovine hyaluronidase purified from bovine testicular extracts (see U.S. Pat. Nos. 2,488,564, 2,488,565, 2,806, 815, 2,808,362, 2,676,139, 2,795,529, 5,747,027 and 5,827, 721). Examples of commercially available purified bovine testicular hyaluronidases include Amphadase® and Hydase™, and bovine hyaluronidases, including, but not limited to, those available from Sigma Aldrich, Abnova, EMD Chemicals, GenWay Biotech, Inc., Raybiotech, Inc., and Calzyme. Also included are recombinantly produced bovine hyaluronidases, such as but not limited to, those generated by expression of a nucleic acid molecule set forth in any of SEQ ID NOS: 190-192.

As used herein, "purified ovine testicular hyaluronidase" refers to an ovine hyaluronidase purified from ovine testicular extracts (see U.S. Pat. Nos. 2,488,564, 2,488,565 and 2,806, 815 and International PCT Publication No. WO2005/ 118799). Examples of commercially available purified ovine testicular extract include Vitrase®, and ovine hyaluronidases, including, but not limited to, those available from Sigma Aldrich, Cell Sciences, EMD Chemicals, GenWay Biotech, Inc., Mybiosource.com and Raybiotech, Inc. Also included are recombinantly produced ovine hyaluronidases, such as, but not limited to, those generated by expression of a nucleic acid molecule set forth in any of SEQ ID NOS: 66 and 193-194.

As used herein, "PH20" refers to a type of hyaluronidase that occurs in sperm and is neutral-active. PH20 occurs on the sperm surface, and in the lysosome-derived acrosome, where it is bound to the inner acrosomal membrane. PH20 includes those of any origin including, but not limited to, human, chimpanzee, Cynomolgus monkey, Rhesus monkey, murine, bovine, ovine, guinea pig, rabbit and rat origin. Exemplary PH20 polypeptides include those from human (SEQ ID NO:1), chimpanzee (SEQ ID NO:101), Rhesus monkey (SEQ ID NO:102), Cynomolgus monkey (SEQ ID NO:29), cow (SEQ ID NOS: 11 and 64), mouse (SEQ ID NO:32), rat (SEQ ID NO:31), rabbit (SEQ ID NO:25), sheep (SEQ ID NOS: 27, 63 and 65) and guinea pig (SEQ ID NO:30).

Reference to hyaluronan-degrading enzymes includes precursor hyaluronan-degrading enzyme polypeptides and mature hyaluronan-degrading enzyme polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NOS: 1 and 10-48, 63-65, 67-102, or the mature forms thereof. For example, reference to hyaluronan-degrading enzyme also includes the human PH20 precursor polypeptide variants set forth in SEQ ID NOS: 50-51. Hyaluronan-degrading enzymes also include those that contain chemical or post-translational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art. A truncated PH20 hyaluronidase is any C-terminal shortened form thereof, particularly forms that are truncated and neutral active when N-glycosylated.

As used herein, a "soluble PH20" refers to any form of PH20 that is soluble under physiologic conditions. A soluble PH20 can be identified, for example, by its partitioning into the aqueous phase of a Triton® X-114 solution at 37° C. (Bordier et al., (1981) *J. Biol. Chem.,* 256:1604-7). Membrane-anchored PH20, such as lipid-anchored PH20, including GPI-anchored PH20, will partition into the detergent-rich phase, but will partition into the detergent-poor or aqueous phase following treatment with Phospholipase-C. Included among soluble PH20 are membrane-anchored PH20 in which one or more regions associated with anchoring of the PH20 to the membrane has been removed or modified, where the soluble form retains hyaluronidase activity. Soluble PH20 also includes recombinant soluble PH20 and those contained in or purified from natural sources, such as, for example, testes extracts from sheep or cows. Exemplary of such soluble PH20 is soluble human PH20.

As used herein, soluble human PH20 or sHuPH20 includes PH20 polypeptides lacking all or a portion of the glycosylphosphatidylinositol (GPI) anchor sequence at the C-terminus such that upon expression, the polypeptides are soluble under physiological conditions. Solubility can be assessed by any suitable method that demonstrates solubility under physiologic conditions. Exemplary of such methods is the Triton® X-114 assay, that assesses partitioning into the aqueous phase and that is described above and in the examples. In addition, a soluble human PH20 polypeptide is, if produced in CHO cells, such as CHO—S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion by CHO cells is definitional. Hence, if a polypeptide could be expressed and secreted by CHO cells and is soluble, i.e., partitions into the aqueous phase when extracted with Triton® X-114, it is a soluble PH20 polypeptide whether or not it is so-produced. The precursor polypeptides for sHuPH20 polypeptides can include a signal sequence, such as a heterologous or non-heterologous (i.e., native) signal sequence. Exemplary of the precursors are those that include a signal sequence, such as the native 35 amino acid signal sequence at amino acid positions 1-35 (see, e.g., amino acids 1-35 of SEQ ID NO:1).

As used herein, an "extended soluble PH20" or "esPH20" includes soluble PH20 polypeptides that contain residues up to the GPI anchor-attachment signal sequence and one or more contiguous residues from the GPI-anchor attachment signal sequence such that the esPH20 is soluble under physiological conditions. Solubility under physiological conditions can be determined by any method known to those of skill in the art. For example, it can be assessed by the Triton® X-114 assay described above and in the examples. In addition, as discussed above, a soluble PH20 is, if produced in CHO cells, such as CHO—S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion by CHO cells is definitional. Hence, if a polypeptide could be expressed and secreted by CHO cells and is soluble, i.e., partitions into the aqueous phase when extracted with Triton® X-114, it is a soluble PH20 polypeptide whether or not it is so-produced. Human soluble esPH20 polypeptides include, in addition to residues 36-490, one or more contiguous amino acids from amino acid residue position 491 of SEQ ID NO:1, inclusive, such that the resulting polypeptide is soluble. Exemplary human esPH20 soluble polypeptides are those that have amino acids residues corresponding to amino acids 36-491, 36-492, 36-493, 36-494, 36-495, 36-496 and 36-497 of SEQ ID NO:1. Exemplary of these are those with an amino acid sequence set forth in any of SEQ ID NOS: 151-154 and 185-187. Also included are allelic variants and other variants, such as any with 40%, 45%, 50%, 55%, 65%, 70%, 75%, 80%, 85%, 90%, 91%, 92%, 93%, 94%, 95%, 96%, 97%, 98%, 99% or greater sequence identity with the corresponding polypeptides of SEQ ID NOS: 151-154 and 185-187 that retain neutral activity and are soluble. Reference to sequence identity refers to variants with amino acid substitutions.

As used herein, reference to "esPH20s" includes precursor esPH20 polypeptides and mature esPH20 polypeptides (such as those in which a signal sequence has been removed), truncated forms thereof that have enzymatic activity (retaining at least 1%, 10%, 20%, 30%, 40%, 50% or more of the full-length form) and are soluble, and includes allelic variants and species variants, variants encoded by splice variants, and other variants, including polypeptides that have at least 40%, 45%, 50%, 55%, 65%, 70%, 75%, 80%, 85%, 90%, 91%, 92%, 93%, 94%, 95%, 96%, 97%, 98%, 99% or more sequence identity to the precursor polypeptides set forth in SEQ ID NOS: 1 and 3, or the mature forms thereof.

As used herein, reference to "esPH20s" also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art.

As used herein, "soluble recombinant human PH20 (rHuPH20)" refers to a composition containing soluble forms of human PH20 as recombinantly expressed and secreted in Chinese Hamster Ovary (CHO) cells. Soluble rHuPH20 is encoded by a nucleic acid molecule that includes a signal sequence and is set forth in SEQ ID NO:49. The nucleic acid encoding soluble rHuPH20 is expressed in CHO cells which secrete the mature polypeptide. As produced in the culture medium, there is heterogeneity at the C-terminus so that the product includes a mixture of species that can include any one or more amino acids 36-477, 36-478, 36-479, 36-480, 36-481 and 36-482 of PH20 (e.g., SEQ ID NO:4 to SEQ ID NO:9) in various abundance.

Similarly, for other forms of PH20, such as the esPH20s, recombinantly expressed polypeptides and compositions thereof can include a plurality of species whose C-terminus exhibits heterogeneity. For example, compositions of recombinantly expressed esPH20 produced by expression of the polypeptide of SEQ ID NO:151, which encodes an esPH20 that has amino acids 36-497, can include forms with fewer amino acids, such as 36-496 or 36-495.

As used herein, an "N-linked moiety" refers to an asparagine (N) amino acid residue of a polypeptide that is capable of being glycosylated by post-translational modification. Exemplary N-linked moieties of human PH20 include amino acids N82, N166, N235, N254, N368 and N393 of human PH20 set forth in SEQ ID NO:1.

As used herein, an "N-glycosylated polypeptide" refers to a PH20 polypeptide or truncated form thereto containing oligosaccharide linkage of at least three N-linked amino acid residues, for example, N-linked moieties corresponding to amino acid residues N235, N368 and N393 of SEQ ID NO:1. An N-glycosylated polypeptide can include a polypeptide where three, four, five and up to all of the N-linked moieties are linked to an oligosaccharide. The N-linked oligosaccharides can include oligomannose, complex, hybrid or sulfated oligosaccharides, or other oligosaccharides and monosaccharides.

As used herein, an "N-partially glycosylated polypeptide" refers to a polypeptide that minimally contains an N-acetylglucosamine glycan linked to at least three N-linked moieties. A partially glycosylated polypeptide can include various glycan forms, including monosaccharides, oligosaccharides, and branched sugar forms, including those formed by treatment of a polypeptide with EndoH, EndoF1, EndoF2 and/or EndoF3.

As used herein, a "deglycosylated PH20 polypeptide" or a polypeptide with "degreased glycosylation" refers to a PH20 polypeptide in which fewer than all possible glycosylation sites are glycosylated. Deglycosylation can be effected, for example, by removing glycosylation, by preventing it, or by modifying the polypeptide to eliminate a glycosylation site. Particular N-glycosylation sites are not required for activity, whereas others are.

As used herein, an "aglycosylated polypeptide" refers to a polypeptide that is not glycosylated.

As used herein, a "polymer" refers to any high molecular weight natural or synthetic moiety that is conjugated to, i.e., stably linked directly or indirectly via a linker, to a polypeptide. Such polymers, typically increase serum half-life, and include, but are not limited to sialic moieties, PEGylation moieties, dextran, and sugar and other moieties, such as glycosylation. For example, hyaluronidases, such as a soluble PH20 or rHuPH20, can be conjugated to a polymer.

As used herein, "PEGylated" refers to covalent or other stable attachment of polymeric molecules, such as polyethylene glycol (PEGylation moiety PEG) to hyaluronan-degrading enzymes, such as hyaluronidases, typically to increase half-life of the hyaluronan-degrading enzyme.

As used herein, a "conjugate" refers to a polypeptide linked directly or indirectly to one or more other polypeptides or chemical moieties. Such conjugates include fusion proteins, those produced by chemical conjugates and those produced by any other methods. For example, a conjugate refers to soluble PH20 polypeptides linked directly or indirectly to one or more other polypeptides or chemical moieties, whereby at least one soluble PH20 polypeptide is linked, directly or indirectly to another polypeptide or chemical moiety so long as the conjugate retains hyaluronidase activity.

As used herein, a "polymer-conjugated hyaluronan-degrading enzyme" refers to a hyaluronan-degrading enzyme that is linked directly or indirectly to a polymer. The linkage can be any type of linkage, including, but not limited to, ionic and covalent bonds, and any other sufficiently stable associated interaction. Reference to a polymer-conjugated hyaluronan-degrading enzyme means that the conjugate exhibits hyaluronidase activity. Typically, the polymer-conjugate exhibits at least 20%, 30%, 40%, 50%, 60%, 70%, 80%, 90% or more of the hyaluronidase activity compared to the hyaluronan-degrading enzyme that is not conjugated to a polymer.

As used herein, "activity" refers to a functional activity or activities of a polypeptide or portion thereof associated with a full-length (complete) protein. For example, active fragments of a polypeptide can exhibit an activity of a full-length protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a hyaluronidase enzyme is its degradation of hyaluronic acid.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are hyaluronan-associated diseases and disorders.

As used herein, a hyaluronan-associated disease, disorder or condition refers to any disease or condition in which hyaluronan levels are elevated as cause, consequence or otherwise observed in the disease or condition. Hyaluronan-associated diseases and conditions are associated with elevated hyaluronan expression in a tissue or cell, increased interstitial fluid pressure, decreased vascular volume, and/or increased water content in a tissue. Hyaluronan-associated diseases, disorders or conditions can be treated by administration of a composition containing an anti-hyaluronan agent, such as a hyaluronan-degrading enzyme, such as a hyaluronidase, for example, a soluble hyaluronidase, either alone or in combination with or in addition to another treatment and/or agent. Exemplary diseases and conditions, include, but are not limited to, inflammatory diseases and hyaluronan-rich cancers. Hyaluronan rich cancers include, for example, tumors, including solid tumors such as late-stage cancers, metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Also exemplary of hyaluronan-associated diseases and conditions are diseases that are associated with elevated interstitial fluid pressure, such as diseases associated with disc pressure, and edema, for example, edema caused by organ transplant, stroke, brain trauma or other injury. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease.

As used herein, amelioration of the symptoms of a particular disease or disorder by a treatment, such as by administration of a pharmaceutical composition or other therapeutic, refers to any lessening, whether permanent or temporary, lasting or transient, of the symptoms or, adverse effects of a condition, such as, for example, reduction of adverse effects associated with or that occur upon administration of a hyaluronan-degrading enzyme, such as a PEGylated hyaluronidase.

As used herein, prevention or prophylaxis refers reduction in the risk of developing a disease or condition.

As used herein, a pharmaceutically effective agent, includes any therapeutic agent or bioactive agents, including, but not limited to, for example, chemotherapeutics, anesthetics, vasoconstrictors, dispersing agents, conventional therapeutic drugs, including small molecule drugs and therapeutic proteins.

As used herein, treatment means any manner in which the symptoms of a condition, disorder or disease or other indication, are ameliorated or otherwise beneficially altered.

As used herein, therapeutic effect means an effect resulting from treatment of a subject that alters, typically improves or ameliorates the symptoms of a disease or condition or that cures a disease or condition.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, the term "subject" refers to an animal, including a mammal, such as a human being.

As used herein, a "patient" refers to a human subject exhibiting symptoms of a disease or disorder.

As used herein, an "individual" can be a subject.

As used herein, "cancer" refers to malignant solid tumors of potentially unlimited growth, as well as various blood cancers that may originate from cancer stem cells in the hypoxic bone marrow, which can expand locally by invasion and systemically by metastasis. Examples of cancers include, but are not limited to cancer of the adrenal gland, bone, brain, breast, bronchi, colon and/or rectum, gallbladder, gastrointestinal tract, head and neck, kidneys, larynx, liver, lung, neural tissue, pancreas, prostate, parathyroid, skin, stomach, and thyroid. Other examples of cancers include, adenocarcinoma, adenoma, basal cell carcinoma, cervical dysplasia and in situ carcinoma, Ewing's sarcoma, epidermoid carcinomas, giant cell tumor, glioblastoma multiforme, hairy-cell tumor, intestinal ganglioneuroma, hyperplastic corneal nerve tumor, islet cell carcinoma, Kaposi's sarcoma, leiomyoma, leukemias, lymphomas, malignant carcinoid, malignant melanomas, malignant hypercalcemia, marfanoid habitus tumor, medullary carcinoma, metastatic skin carcinoma, mucosal neuroma, myelodysplastic syndrome, myeloma, mycosis fungoides, neuroblastoma, osteosarcoma, osteogenic and other sarcoma, ovarian tumor, pheochromocytoma, polycythemia vera, primary brain tumor, small-cell lung tumor, squamous cell carcinoma of both ulcerating and papillary type, seminoma, soft tissue sarcoma, retinoblastoma, rhabdomyosarcoma, renal cell tumor or renal cell carcinoma, reticulum cell sarcoma, and Wilm's tumor. Examples of cancers also include astrocytoma, a gastrointestinal stromal tumor (GIST), a glioma or glioblastoma, renal cell carcinoma (RCC), hepatocellular carcinoma (HCC), and a pancreatic neuroendocrine cancer.

As used herein, a "hyperproliferative disease" refers to a disease characterized by cellular hyperproliferation that involves an abnormally increased rate or amount of cellular proliferation. Such disease and conditions include cancer as well as other diseases, such as those where the hyperproliferation is part of an immune reaction, as occurs in autoimmune disorders. Examples of hyperproliferative diseases include, but are not limited to, cancer, allergic angitis and granulomatosis (Churg-Strauss disease), asbestosis, asthma, atrophic gastritis, benign prostatic hyperplasia, bullous pemphigoid, coeliac disease, chronic bronchitis and chronic obstructive airway disease, chronic sinusitis, Crohn's disease, demyelinating neuropathies, dermatomyositis, eczema including atopic dermatitis, eustachian tube diseases giant cell arteritis, graft rejection, hypersensitivity pneumonitis, hypersensitivity vasculitis (Henoch-Schonlein purpura), irritant dermatitis, inflammatory hemolytic anemia, inflammatory neutropenia, inflammatory bowel disease, Kawasaki's disease, multiple sclerosis, myocarditis, myositis, nasal polyps, nasolacrimal duct diseases, neoplastic vasculitis, pancreatitis, pemphigus vulgaris, primary glomerulonephritis, psoriasis, periodontal disease, polycystic kidney disease, polyarteritis nodosa, polyangiitis overlap syndrome, primary sclerosing cholangitis, rheumatoid arthritis, serum sickness, surgical adhesions, stenosis or restenosis, scleritis, scleroderma, strictures of bile ducts strictures (of duodenum, small bowel, and colon), silicosis and other forms of pneumoconiosis, type I diabetes, ulcerative colitis ulcerative proctitis, vasculitis associated with connective tissue disorders, vasculitis associated with congenital deficiencies of the complement system, vasculitis of the central nervous system, and Wegener's granulomatosis.

As used herein, "Combination therapy" refers to the use of two or more drugs in therapy, i.e., use of a hypoxia activated prodrug as described herein together with conventional drugs used to treat blood cancer is a combination therapy.

As used herein, administration in "combination" refers to the administration of two agents (e.g., a hypoxia activated prodrug and an agent known for treating a blood cancer) in any manner in which the pharmacological effects of both manifest in the patient at the same time. Thus, administration in combination does not require that a single pharmaceutical composition, the same dosage form, or even the same route of administration be used for administration of both agents or that the two agents be administered at precisely the same time.

As used herein, "Relapsed or refractory" refers to a type of cancer or blood cancer that is resistant to treatment with an agent, or responds to treatment with an agent but comes back without being resistant to that agent, or responds to treatment with an agent but comes back resistant to that agent.

As used herein, about the same means within an amount that one of skill in the art would consider to be the same or to be within an acceptable range of error. For example, typically, for pharmaceutical compositions, an amount within at least 1%, 2%, 3%, 4%, 5% or 10% is considered about the same. Such amount can vary depending upon the tolerance for variation in the particular composition by subjects.

As used herein, "intravenous administration" refers to delivery of a therapeutic directly into a vein.

As used herein, dosing regime refers to the amount of agent, for example, the composition containing a hyaluronan-degrading enzyme, for example a soluble hyaluronidase or other agent, administered, and the frequency of administration. The dosing regime is a function of the disease or condition to be treated, and thus can vary.

As used herein, frequency of administration refers to the time between successive administrations of treatment. For example, frequency can be days, weeks or months. For example, frequency can be more than once weekly, for example, twice a week, three times a week, four times a week, five times a week, six times a week or daily. Frequency also can be one, two, three or four weeks. The particular frequency is a function of the particular disease or condition treated. Generally, frequency is more than once weekly, and generally is twice weekly.

As used herein, a "cycle of administration" refers to the repeated schedule of the dosing regime of administration of the enzyme and/or a second agent that is repeated over successive administrations. For example, an exemplary cycle of administration is a 28 day cycle with administration twice weekly for three weeks, followed by one-week of discontinued dosing.

As used herein, when referencing dosage based on mg/kg of the subject, an average human subject is considered to have a mass of about 70 kg-75 kg, such as 70 kg.

As used herein, unit dose form refers to physically discrete units suitable for human and animal subjects and packaged individually as is known in the art.

As used herein, a single dosage formulation refers to a formulation as a single dose.

As used herein, formulation for direct administration means that the composition does not require further dilution for administration.

As used herein, an "article of manufacture" is a product that is made and sold. As used throughout this application, the term is intended to encompass anti-hyaluronan agents, for example hyaluronan-degrading enzyme, such as hyaluronidase, and second agent compositions contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; pigs and other animals. Non-human animals exclude humans as the contemplated animal. The hyaluronidases provided herein are from any source, animal, plant, prokaryotic and fungal. Most hyaluronidases are of animal origin, including mammalian origin. Generally hyaluronidases are of human origin.

As used herein, anti-cancer treatments include administration of drugs and other agents for treating cancer, and also treatment protocols, such as surgery and radiation. Anti-cancer treatments include administration of anti-cancer agents.

As used herein, an anti-cancer agent refers to any agents, or compounds, used in anti-cancer treatment. These include any agents, when used alone or in combination with other compounds, that can alleviate, reduce, ameliorate, prevent, or place or maintain in a state of remission of clinical symptoms or diagnostic markers associated with tumors and cancer, and can be used in combinations and compositions provided herein. Exemplary anti-cancer agents include, but are not limited to, hyaluronan-degrading enzymes, such as the PEGylated hyaluronan-degrading enzymes provided herein used singly or in combination with other anti-cancer agents, such as chemotherapeutics, polypeptides, antibodies, peptides, small molecules or gene therapy vectors, viruses or DNA.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound comprising or containing "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases." Generally "about" includes an amount that would be expected to be within experimental error.

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. HYPOXIA, HYALURONAN AND RELATED AGENTS AND MARKERS FOR TREATMENT

Provided herein are methods of diagnosing, prognosing or monitoring a tumor or other disease or condition based on the finding that targeting hyaluronan and hypoxia are related therapeutic and marker targets. For example, such conditions can be treated by targeting the hypoxia and/or targeting degradation of hyaluronan. Given the association between hyaluronan levels and the extent of hypoxia, and vice versa, treatment methods are provided herein to select or monitor subjects in order to optimize response to a particular treatment protocol based on the underlying hypoxic condition.

The methods permit identification or monitoring of hyaluronan-associated diseases and conditions that are characterized as hypoxia-related conditions and vice versa. For example, hyaluronan-associated markers and/or hypoxia detecting agents can be used to select, identify or predict subjects that are likely to be susceptible to treatment with a hypoxia-activated agent, anti-hyaluronan agent or both, or that are susceptible to treatment with a hypoxia-activated agent, anti-hyaluronan agent or both. The methods provided herein can be used to optimize the treatment protocol of individual patients, thereby maximizing the number of patients who respond to the treatment while minimizing the extent of disease progression who could otherwise benefit from an alternative treatment.

1. Hypoxia and Related Diseases and Conditions

Hypoxia is responsible for regulating a number of cellular and systemic processes, including angiogenesis, erythropoiesis, and glycolysis. Hypoxic insult also plays a role in a variety of severe pathological conditions including ischemia, retinopathy, neonatal distress, and cancer. Hypoxia, a low oxygen state, has been established to play a key role in neoplastic tissues. Hypoxia is a reduction in the normal level of tissue oxygen tension. It occurs during acute and chronic vascular disease, pulmonary disease and cancer, and produces cell death if prolonged. Pathways that are regulated by hypoxia include angiogenesis, glycolysis, growth-factor signaling, immortalization, genetic instability, tissue invasion and metastasis, apoptosis and pH regulation (Harris, A. L. (2002) Nature Reviews *Cancer*, 2: 38-47). Hypoxia can be graded as a function of the oxygenation conditions as follows: physiologic oxygenation as >10% oxygen, modest hypoxia as approximately 2.5% oxygen, moderate hypoxia as approximately 0.5% and severe hypoxia as approximately 0.1% oxygen (Evans and Koch, Cancer Letters, 195: 1-16 (2003)). Generally, hypoxic tissues and cells include those having an oxygen content less than 5%, such as less than 4%, 3%, 2%, 1% or less.

Tumors become hypoxic because new blood vessels that develop in the tumors are aberrant and have poor blood flow. Although hypoxia is toxic to both tumor cells and normal cells, tumor cells undergo genetic and adaptive changes that allow them to survive and even proliferate in a hypoxic environment. These processes contribute to the malignant phenotype and to aggressive tumor behavior. Intratumoral hypoxia is a hallmark of most solid tumors and results from increased oxygen consumption and/or insufficient blood supply. Hence, hypoxia is a common characteristics of many solid tumors. The progression of human tumors to malignancy is an evolutionary process involving the differential expression of multiple genes in response to unique microenvironments. Low oxygen conditions create a dominant tumor microenvironment that directly favors processes driving malignant progression, such as angiogenesis or elimination of p53 tumor suppressor activity. The degree of hypoxia, however, differs widely depending on the type and context of the tumor cells. Also, the fraction of cells that are hypoxic can be variable within a tumor. Many cancer cells are more hypoxic relative to normal cells.

Hypoxia is often associated with aggressive tumor phenotypes and poor prognosis, affecting angiogenesis, vasculogenesis, invasiveness, metastasis, resistance to therapy, epithelial-to-mesenchymal transition, altered metabolism and genomic instability. Tumor vasculature is frequently abnormal, preventing sufficient oxygen delivery to the cells, and available oxygen is also rapidly consumed by proliferating tumor cells, thereby further limiting available oxygen for tumor cells in the hypoxic zone.

Tumor hypoxia is associated with resistance to anticancer therapies, cancer relapse and poor prognosis. In addition to promoting further tumor growth, the abnormally low oxygen levels that are found in nearly all solid tumors negatively impact therapeutic efforts. Certain regions of solid tumors have very low oxygen levels, and cells in these regions are resistant to radiotherapy or chemotherapy. For example, hypoxia has been found to correlate with radioresistance of tumors, as well as tumor aggressiveness and poor prognosis (Hockel et al. (1993) Radiother. Oncol., 26: 45-50; Hockel et al. (1996) Cancer Res., 56: 4509-4515; Brizel et al. (1996) Cancer Res., 56: 941-943). The impact of tumor hypoxia on prognosis is most clear in head and neck tumors (Nordsmark and Overgaard (2000) Radiother. Oncol., 57: 39-43). Radiobiologically relevant hypoxic cells are variously defined, but often considered to contain less than about 1% oxygen, with a half-maximal response close to 0.5% oxygen (Olive and Aquino-Parsons (2004) Seminars in Radiation Oncology, 14(3): 241-248).

Hypoxia contributes to resistance to therapy through multiple mechanisms, including cell cycle arrest, resistance to apoptosis, suppression of DNA repair, genomic instability and transcriptional activation of genes involved in angiogenesis, glucose metabolism, proliferation and metastasis through hypoxia-inducible factor-1 (HIF-1), a master regulator of hypoxic response genes (Lu and Kang (2010) Clin Cancer Res. 16(24):5928-35, Wilson and Hay (2011) Nat Rev Cancer. 11(6):393-410). Also, hypoxic cell resistance to both chemotherapy and radiation therapy can be attributed to limited accessibility of hypoxic cells and the probability that hypoxic cells are noncycling.

2. Hyaluronan and Related Diseases and Conditions

HA, also called hyaluronic acid, hyaluronate or hyaluronan, is a high molecular weight linear glycosaminoglycan that contains repeating disaccharide units, $\beta$1,3N-acetyl-D-glucosamine-linked $\beta$1,4 to D-glucoronic acid. Hyaluronan chains can reach about 25,000 disaccharide repeats or more in length and polymers of hyaluronan can range in size from about 5,000 to 20,000,000 Da in vivo. Hyaluronan is widely distributed throughout connective, epithelial, and neural tissues. It also is a major component of the extracellular matrix and a constituent of the interstitial barrier. By catalyzing the hydrolysis of hyaluronan, hyaluronan-degrading enzymes lower the viscosity of hyaluronan, thereby increasing tissue permeability and increasing the absorption rate of fluids administered parenterally. As such, hyaluronan-degrading enzymes, such as hyaluronidases, have been used, for example, as spreading or dispersing agents in conjunction with other agents, drugs and proteins to enhance their dispersion and delivery.

HA also is involved in disease. HA accumulation, such as by altered hyaluronan metabolism, distribution and function is associated with arthritis, immune and inflammatory disorders, pulmonary and vascular diseases and cancer (Morohashi et al. (2006) Biochem. Biophys. Res. Comm., 345: 1454-1459). Such diseases can be treated by inhibiting HA synthesis or degrading HA (see e.g., Morohashi 2006; U.S. Patent Publication No. 20100003238 and International PCT Publication No. WO 2009/128917).

In particular, HA is a component of the tumor matrix and is present in many solid tumors. Accumulation of HA within a tumor focus prevents cell-cell contact, promotes epithelial-mesenchymal transitions, is involved with the p53 tumor suppressor pathway via its receptors RHAMM and CD44 and recruits tumor-associated macrophages (Itano et al. (2008) Cancer Sci 99: 1720-1725; Camenisch et al. (2000) J Clin Invest 106:349-360; Thompson et al. (2010) Mol. Cancer. Ther. 9:3052-64). The assembly of a pericellular matrix rich in HA is a prerequisite for proliferation and migration of mesenchymal cells that can promote metastatic behavior. Tumors characterized by the accumulation of HA also exhibit tumor water uptake and have high interstitial fluid pressure (IFP) that can inhibit penetration of and accessibility of the tumor to systemically applied therapeutics, such as chemotherapeutics. Further, HA oligomers, generated by degradation by Hyal1, also have been shown to result in angiogenesis or apoptosis that can contribute to tumor pathogenesis.

In particular, HA degrading enzymes, such a hyaluronidase, for example PH20, have been shown to remove HA from tumors resulting in the reduction of tumor volume, the reduction of IFP, the slowing of tumor cell proliferation, and the enhanced efficacy of co-administered chemotherapeutic drugs and biological agents by permitting increased tumor penetration (see e.g., U.S. Patent Publication No. 20100003238 and International PCT Publication No WO 2009/128917; Thompson et al. (2010) Mol. Cancer. Ther 9:3052-3064).

The ability of a hyaluronidase, such as PH20, to degrade HA to serve as a therapeutic of hyaluronan-associated diseases and disorders can be exploited by modification to increase systemic half-life. The increased half-life permits not only the removal of HA, but also, due to its continued presence in the plasma and its ability to degrade HA, reduces or decreases the extent of regeneration of HA within diseased tissues, such as the tumor. Hence, maintenance of plasma enzyme levels can remove HA, such as tumor HA, and also counteract HA resynthesis. PEGylation is an established technology used to increase the half-life of therapeutic proteins in the body thus enabling their use in systemic treatment protocols. PEGylation of anti-hyaluronan agents, such as hyaluronan-degrading enzymes, such as hyaluronidase extends its half-life in the body from less than a minute to approximately 48 to 72 hours and allows for the systemic treatment of tumors rich in HA (see e.g., U.S. Patent Publication No. 20100003238 and International PCT Publication No WO 2009/128917; Thompson et al. (2010) Mol Cancer Ther 9: 3052-3064).

3. Hyaluronan and/or Hypoxia as Therapeutic Markers

It is found herein that the level or amount of hyaluronan is associated with hypoxia-related diseases or conditions (e.g., hypoxic tumors). For example, as demonstrated in the Examples herein, it is shown that hyaluronan is present on tumors, and the degree of the level or amount is an indicator of the hypoxic state of a tissue or cell. For example, it is shown herein that treatment of tumors with a hyaluronan-degrading enzyme (e.g., PEGPH20), which is an enzyme that degrades hyaluronan, results in a reduction in the hypoxic area of tumors. This reduction is greater in high hyaluronan ($HA^{+3}$) tumors than in low to moderate hyaluronan-associated tumors. Further, the reduction in the hypoxic area of tumors also correlates with a decrease in vascular perfusion and also tumor growth.

Hence, HA and other hyaluronan-associated markers can be used in methods of diagnosis, prognosis and monitoring of hypoxia-related diseases and conditions. The diagnostic use of hyaluronan-associated markers can improve treatment methods with hypoxia-activated agents that are selective for hypoxic tissues in cells by selecting patients that are most likely to be susceptible to such treatments. In one example, provided herein are methods of diagnosing or prognosing a hypoxia-related disease or condition for treatment with a hypoxia-activated agent based on the level or amount of a hyaluronan-associated marker in a sample of a subject. Hypoxia-related diseases and conditions can be specifically treated with hypoxia-activated agents that act preferentially in hypoxic cell and tissues while minimizing toxic activity on normal cells. Thus, the methods provided herein can be used to select a subset of subjects having a hypoxia-related disease or condition based on the presence of a hyaluronan-associated marker for the purpose of selective treatment with a hypoxia-activated agent. The treatment with a hypoxia-activated agent also can be monitored using a hyaluronan-associated marker.

Conversely, since reduction in hypoxia is a surrogate marker of therapeutic efficacy of an anti-hyaluronan agent, hypoxia-detecting agents can be used to monitor treatments with an anti-hyaluronan agent. Hence, provided herein are methods of monitoring treatment with an anti-hyaluronan agent (e.g a hyaluronan-degrading enzyme or modified form thereof, such as PEGPH20) based on assessing the level or extent of hypoxia in a sample after treatment. For example, hypoxia can be assessed using a hypoxia detecting agent. Reduction of hypoxia following treatment with an anti-hyaluronan agent is an indicator that treatment is working, and subjects identified as having a reduction in the extent of hypoxia are identified as responders to treatment with an anti-hyaluronan agent.

The following subsection describe exemplary aspects of any of the above methods herein of selecting or monitoring subjects for treatment with hypoxia-activated agents or anti-hyaluronan agents as described herein. Such methods can utilize hyaluronan-associated markers or hypoxia-detecting agents. Non-limiting examples of such therapies, and associated markers, are described below.

C. METHODS OF DIAGNOSIS AND PROGNOSIS OF HYPOXIC DISEASES AND CONDITIONS USING A HYALURONAN-ASSOCIATED MARKER

Provided herein are methods of assaying the level or extent of a hyaluronan-associated marker as an indicator of hypoxia for use in determining the presence of hypoxia in a tissue in an animal and/or evaluating a hypoxia-related condition in an animal. Hypoxia is associated with many hypoxia-related diseases and conditions, including hyperproliferative diseases. The methods provided herein can be used to select subjects having a hypoxia-related disease or condition, such as a hyperproliferative disease or condition, for treatment with a hypoxia-activated agent. Hence, the methods provided herein include methods for selecting subjects for treating with a hypoxia-activated agent based on the expression or level of a hyaluronan-associated marker in a subject.

Hypoxia is associated with resistance to radiation therapy and chemotherapy, but is also associated with poor outcome regardless of treatment modality, indicating that it is a therapeutic target. As hypoxia is often associated with tumors and contributes significantly to resistance to therapy, it is a target for selective tumor therapy. Several compounds are being developed both in the preclinical and clinical trial stages. Certain drugs in preclinical and clinical development target hypoxic cancer cells. These drugs, called hypoxia-activated prodrugs or "HAPs" are administered in an inactive, or prodrug, form but are activated, and become toxic, in a hypoxic environment (see e.g., PCT Pat Pub Nos WO 07/002,931 and WO 08/083,101, and others cited elsewhere herein). The efficacy of hypoxia-activated agents are affected by several factors, including the hypoxic cytotoxicity ratio, degree of hypoxia in the tumor, expression of specific reductases, and solubility, stability and bioavailability of the drug.

Although many of these drugs have proven to selectively kill tumors in the preclinical setting, clinical efficacy for some compounds has been limited due to the lack of screening for hypoxic state of the tumor or for the expression of the required reductases, or poor bioavailability (Bennewith et al., BMC Cancer (2011) 11:504). Traditionally, the gold standard for measuring hypoxia has been the use of a polarographic oxygen-sensitive probe, which provides direct measurement of tissue oxygen tension. However, this method has limitations, such as its inability to differentiate between viable and necrotic foci, the inaccessibility of many tumor tissues, including those associated with hematologic malignancies of the bone marrow, and the lack of a practical means to apply the technique in large scale.

Hence, many existing techniques for assessing or measuring hypoxia can be invasive and/or are not specific or selective for tissues or cells associated with a hypoxia-related disease or condition. Also, many markers do not predict the aggressiveness of a disease or condition as the level or amount of a marker does not correlate to disease prognosis. A negative aspect of using exogenous markers such as EF5 or pimonidazole to predict radiation resistance of a tumor is that it requires injection of a chemical into a patient, again requiring an invasive technique beyond the initial biopsy.

As shown herein, hyaluronan (HA) also is associated with hypoxic conditions. Hence, HA and other hyaluronan-associated markers can be used in methods of diagnosis, prognosis and monitoring of hypoxia-related diseases and conditions. The diagnostic use of hyaluronan-associated markers can improve treatment methods with hypoxia-activated agents that are selective for hypoxic tissues in cells by selecting patients that are most likely to be susceptible to such treatments.

The methods provided include methods for selecting a subject for treatment of a hypoxia-related disease or condition with a hypoxia-activated agent by a) measuring the expression or level of a hyaluronan-associated marker in a sample from a subject and b) if the marker is at or above a predetermined threshold level, selecting the subject for treatment with a hypoxia-activated agent.

1. Hyaluronan-Associated Markers and Assays to Detect or Assess Hyaluronan-Associated Markers Hyaluronan-associated markers include, for example, hyaluronan and proteins that modulate the synthesis and degradation of hyaluronan, such as a hyaluronan synthase or a hyaluronan-degrading enzyme (e.g., a hyaluronidase), respectively.

Exemplary assays for detecting markers are described below, and include assays for measuring HA expression and/or relative HA expression in a sample from a subject, assays for analyzing effects of hyaluronan-degrading enzymes on a sample from the subject, and assays for measuring readouts typically associated with certain hyaluronan-associated diseases/conditions, such as low hyaluronidase expression or activity, high interstitial fluid pressure, vascular volume and water content. In general, any known assay for detection of proteins or nucleic acids in samples from subjects, or for assessing the effects of treatment on cells/tissues in vitro can be used. The assays can be performed in vitro or in vivo. By comparisons to a control or reference sample or classifications based on a predetermined level, such values can be used for diagnosis or prognosis of a hypoxia-related disease or condition, to predict responsiveness of a subject having a hypoxia-related disease or condition to a therapy with a hypoxia-activated agent, and/or to monitor or predict efficacy of treatment of a subject having a hypoxia-related disease or condition that has been treated with a hypoxia-activated agent therapy.

The assays to detect hyaluronan-associated markers include assays to directly or indirectly measure amount (e.g., relative amount) of hyaluronan and/or hyaluronidase expression in a tissue, cell and/or body fluid of a subject, for example, a tumor. Included amongst such assays are those that can detect HA expression, Hyaluronan synthase 2 (HAS2) expression, the presence of HALOs (pericellular matrix regions that are rich in proteoglycans, including hyaluronan), and the presence of hyaluronan-degrading enzymes, such as hyaluronidases, for example, in samples from the subject.

Assays to detect protein and nucleic acid levels are well known in the art and can be used in the methods herein to measure hyaluronan, hyaluronan synthase or other protein and/or nucleic acid expression. Such assays include, but are not limited to, ELISA, SDS-PAGE, Western Blot, PCR, RT-PCR, immunohistochemistry, histology and flow cytometry. For example, a sample from a subject, such as a tissue sample (e.g., a biopsy of a tumor from a patient or animal model, a stromal sample), a fluid (e.g., blood, urine, plasma, saliva or other sample), a cell or cellular sample, or extract, or other sample, can be subjected to ELISA, SDS-PAGE, Western Blot, PCR, RT-PCR, immunohistochemistry, histology and flow cytometry in order to assess, quantify or determine the extent or level of a hyaluronan-associated marker in a subject.

In particular examples, for measuring or assessing hyaluronan in a sample from a subject, a sample from a subject can be contacted with a hyaluronan-binding protein (e.g., an anti-HA antibody or an HABP containing an HA binding domain, such as any described above) and binding thereto determined. Binding can be determined using a multitude of assays and techniques known to one of skill in the art.

For example, binding can be determined using histological staining, such as immunohistochemistry (IHC) of fixed or frozen tissue sections, to determine the presence and extent of hyaluronan in the tissue or sample, immunofluorescent cellular staining, pull-down assays, flow cytometry or solid phase binding assays. In another example, the sample, e.g., biopsy, can be assayed by RT-PCR to assess the amount of HA mRNA. Exemplary of such assays are described below and include histochemical or immunohistochemical methods of solid phase binding assays.

In another example, a sample from a subject can be measured or assessed for the presence of a hyaluronan synthase (e.g., hyaluronan synthase 2) using a multitude of assays and techniques known to one of skill in the art. For example, production and/or expression of a hyaluronan synthase, such as hyaluronan synthase 2 (HAS2), by cells in vitro, ex vivo or in vivo by ELISA, SDS-PAGE, Western Blot, PCR, RT-PCR, immunohistochemistry, histology or flow cytometry.

In further example, the amount of a hyaluronan-degrading enzyme (e.g., a hyalruonidase) in a sample from the subject, such as in the blood or plasma, can be measured or assessed. For example, the amount of activity of a hyaluronan-degrading enzyme (e.g., hyaluronidase activity) in a sample from the subject can be determined using a turbidity assay or a microtiter-based assay for degradation of biotinylated hyaluronan (see e.g., Frost and Stern (1997) Anal. Biochem. 251:263-269, U.S. Patent Publication No. 20050260186).

In another example, a cell or other tissue from a patient is isolated, e.g., a tumor cell, and used in a study to determine whether the cell or tissue is responsive to treatment with the hyaluronan degrading enzyme in vitro, for example, using a clonogenic assay or any other assay for measuring growth, proliferation and/or survival of cells or tissues, such as tumor cells, in response to treatment. For example, cancer cells from a subject can be seeded on surface, such as an extracellular matrix or protein mixture, such as the mixture sold under the trade name Matrigel® (BD Biosciences). In this example, the hyaluronan-associated marker is the sensitivity of the cell or tissue to administration of hyaluronan degrading enzyme. If any property, such as proliferation, growth or survival of the cells, is inhibited or blocked by addition of hyaluronan degrading enzyme compared to a control or reference, it is determined that there is an altered level or amount of hyaluronan in the sample.

In addition to assays for determining hyaluronan expression levels, other assays can be used to assess parameters or properties associated with a hyaluronan-associated marker. These include assays for monitoring or assaying interstitial fluid pressure, vascular volume, water content, or the ability to form pericellular Halo matrices. For example, interstitial fluid pressure (IFP) can be measured using an appropriate probe or instrument. For example, a transducer-tipped catheter can be used to measure the IFP in cancer tissues or other tissues of interest. The catheter is passed through the inner bore of a surgical needle, which is then inserted into the center of the tumor. The needle is withdrawn while the catheter is held in position. The IFP (mmHg) can then be measured using an appropriate data acquisition unit (see e.g., Example 6B, Ozerdem et al. (2005) Microvasc. Res. 70:116-120). Other methods to measure IFP include the wick-in-needle method (Fadnes et al (1977) Microvasc. Res. 14:27-36). Vascular volume can be measured by, for example, ultrasound imaging. This method employs hyper-echoic microbubbles to provide the strong ultrasound wave reflections that are detected. The microbubbles, when injected, such as intravenously, into a subject or animal model, become trapped in the vascular space due to their size. Assays to assess tissue water content, such as tumor tissue water content, also are known in the art. For example, samples from a tumor can be harvested, blotted, weighed and snap frozen before being lyophilized. The water weight is then reported as the tissue wet weight to dry (i.e., lyophilized) weight ratio. The ability of a tumor cell to form pericellular matrices (halos) in vitro can be assessed using a particle exclusion assay (see e.g., Example 6). Small particles (formalin-fixed red blood cells) can be added to low-density cultures of tumor cells in the presence of, for example, aggrecan, which is a large aggregating chondroitin sulfate proteoglycan. After the particles settle, the cultures can be viewed at 400× magnification to determine whether any halos were formed by the tumor cells. This can be visualized as areas around the cells from which the particles are excluded.

In particular, in the methods provided herein, the level or amount of hyaluronan in a sample is determined or measured. Assays to assess hyaluronan in a sample are known to one skilled in the art. Exemplary assays utilize a hyaluronan-binding protein (HABP), such as any set forth in Section D, that specifically binds to hyaluronan in a sample.

Assays for Measuring Hyaluronan

In one example, based on the levels or expression of hyaluronan, a patient or subject can be selected for treatment with a hypoxia-activated agent. For example, a sample from a subject can be contacted with a hyaluronan-binding protein (HABP), such as any described above (e.g., a TSG-6-LM, a multimer or variant thereof), and the binding of the HABP to the sample can be detected in order to determine the amount of hyaluronan in the sample. Based on predetermined selection or classification criteria as described herein, a patient can be diagnosed with a hypoxia-related disease or condition, and hence selected for treatment of the disease or condition with a hypoxia-activated agent. In particular examples herein, based on the predetermined selection or classification criteria as described herein, a patient or subject can be selected for treatment that is predicted to be responsive to treatment with a hypoxia-activated agent. Hence, the method can be used to predict the efficacy of treatment by a hypoxia-activated agent.

Also, based on the predetermined selection or classification criteria as described herein, the methods herein can be used for prognosis of the subject. Depending on the course of the disease or condition, the dose, treatment schedule and/or dosing regime of the hypoxia-activated agent can be optimized and adjusted accordingly.

For example, for purposes herein, patients having tumor hypoxia can be selected for treatment with a hypoxia-activated agent or in combination with a second agent. In such examples, the tumor can be directly biopsied and stained for expression of HA. In other examples, a sample, such as a blood or urine sample or other bodily fluid sample associated with the particular tumor can be assayed for HA. The type of assay will vary depending on the tumor-type, although it is contemplated that more than one assay can be used to detect HA. References herein to such assays for particular tumors are for illustration only. For example, for bladder cancers, urine samples can be assayed for hyaluronan by standard ELISA procedures. For purposes herein, subjects that exhibit 1.5-fold, 2-fold, 3-fold, 4-fold, 5-fold, 6-fold, 7-fold, 8-fold, 9-fold, 10-fold or more HA compared to urine from normal patient controls (see e.g., Lokeshwar et al. (2000) J. Urol., 163:348-56), can be selected. In another example, tumor cells can be biopsied and stained for HA, such as by immunohistochemistry (see e.g., Anttila et al. (2000) Cancer Research, 60:150-155; Karvinen et al. (2003) British J of Dermatology, 148:86-94; Lipponen et al. (2001) Euro J Can. 37: 849-856); Auvinen et al. (2000) American J of Pathology, 156:529). Generally, in such examples, a tumor sample or tumor cell is considered positive for HA if any cancer-cell associated HA signal is observed. As a negative control for background staining, cells can be predigested with a hyaluronidase to cleave all cell-associated HA. Samples also can be compared to a normal cell or tissue from the same subject. In addition, in such methods, the level of cell-associated hyaluronan can be scored as low, moderate or high. For example, HA expression is considered low if less than 10% of the tumoral area shows HA signal, moderate if 10 to 25% of the tumoral area is HA positive and high if at least 25%, 30%, 35%, 40%, 50%, 60%, 70%, 75%, 80%, 85%, 90% or more of the tumoral area shows persistent HA signal. Typically, treatment of subjects with a hypoxia-activated agent is effected by selection of subjects exhibiting moderate to high HA.

It is within the level of one of skill in the art to assess, quantify, determine and/or detect hyaluronan levels in a sample using an HABP companion diagnostic, such as TSG-6-LM, multimer (e.g., TSG-6-LM-Fc) or variant thereof, as described herein. Assays include in vitro or in vivo assays. Exemplary of binding assays that can be used to assess, evaluate, determine, quantify and/or otherwise specifically detect hyaluronan expression or levels in a sample include, but are not limited to, solid phase binding assays (e.g., enzyme linked immunosorbent assay (ELISA)), radioimmunoassay (RIA), imoassmunoradiometric assay, fluorecence assay, chemiluminescent assay, bioluminescent assay, western blot and histochemistry methods, such as immunohistochemistry (IHC) or pseudo immunohistochemistry using a non-antibody binding agent. In solid phase binding assay methods, such as ELISA methods, for example, the assay can be a sandwich format or a competitive inhibition format. In other examples, in vivo imaging methods can be used.

i. Histochemical and Immunohistochemical Methods

The methods of assessing hyaluronan in a sample as an indicator of hypoxia are based on the ability of an HABP reagent to bind to HA in a sample, for example a tissue or cell sample, such that the amount of the HABP that binds correlates with amount of HA in the sample. Any HABP described herein in Section E can be used to detect HA using tissue staining methods known to one of skill in the art, including but not limited to, cytochemical or histochemical methods, such as immunohistochemistry (IHC) or histochemistry using a non-antibody binding agent (e.g., pseudo immunohistochemistry). Such histochemical methods permit quantitative or semi-quantitative detection of the amount of HABP that binds to HA in a sample, such as a tumor tissue sample. In such methods, a tissue sample can be contacted with an HABP reagent provided herein, and in particular one that is detectably labeled or capable of detection, under conditions that permit binding to tissue- or cell-associated HA.

A sample for use in the methods provided herein as determined by histochemistry can be any biological sample that can be analyzed for its HA levels, such as a tissue or cellular sample. For example, a tissue sample can be solid tissue, including a fresh, frozen and/or preserved organ or tissue sample or biopsy or aspirate, or cells. In some examples, the tissue sample is tissue or cells obtained from a solid tumor, such as primary and metastatic tumors, including but not limited to, breast, colon, rectum, lung, stomach, ovary, cervix, uterus, testes, bladder, prostate, thyroid and lung cancer tumors. In particular examples, the sample is a tissue sample cancer is a late-stage cancer, a metastatic cancer, an undifferentiated cancer, ovarian cancer, in situ carcinoma (ISC), squamous cell carcinoma (SCC), prostate cancer, pancreatic cancer, non-small cell lung cancer, breast cancer, or colon cancer. In other examples, the tissue sample contains cells from primary or cultured cells or cell lines. Cells may be have various states of differentiation, and may be normal, pre-cancerous or cancerous, may be fresh tissues, diespersed cells, immature cells, including stem cells, cells of intermediate maturity and fully matured cells. Typically, the cells selected for use in the methods provided herein are cancer cells.

When the tumor is a solid tumor, isolation of tumor cells is typically achieved by surgical biopsy. Biopsy techniques that can be used to harvest tumor cells from a subject include, but are not limited to, needle biopsy, CT-guided needle biopsy, aspiration biopsy, endoscopic biopsy, bronchoscopic biopsy, bronchial lavage, incisional biopsy, excisional biopsy, punch biopsy, shave biopsy, skin biopsy, bone marrow biopsy, and the Loop Electrosurgical Excision Procedure (LEEP). Typically, a non-necrotic, sterile biopsy or specimen is obtained that is greater than 100 mg, but which can be smaller, such as less than 100 mg, 50 mg or less, 10 mg or less or 5 mg or less; or larger, such as more than 100 mg, 200 mg or more, or 500 mg or more, 1 gm or more, 2 gm or more, 3 gm or more, 4 gm or more or 5 gm or more. The sample size to be extracted for the assay can depend on a number of factors including, but not limited to, the number of assays to be performed, the health of the tissue sample, the type of cancer, and the condition of the subject. The tumor tissue is placed in a sterile vessel, such as a sterile tube or culture plate, and can be optionally immersed in an appropriate medium.

Tissue obtained from the patient after biopsy is often fixed, usually by formalin (formaldehyde) or glutaraldehyde, for example, or by alcohol immersion. For histochemical methods, the tumor sample can be processed using known techniques, such as dehydration and embedding the tumor tissue in a paraffin wax or other solid supports known to those of skill in the art (see Plenat et al., (2001) *Ann Pathol* 21(1):29-47), slicing the tissue into sections suitable for staining, and processing the sections for staining according to the histochemical staining method selected, including removal of solid supports for embedding by organic solvents, for example, and rehydration of preserved tissue. Thus, samples for use in the methods herein can contain compounds that are not naturally present in a tissue or cellular sample, including for example, preservatives, anticoagulants, buffers, fixatives, nutrients and antibiotics.

In exemplary methods to select a subject for treatment with a hypoxia-activated agent, harvesting of the tumor tissue is generally performed prior to treatment of the subject with a hypoxia-activated agent. In exemplary methods of monitoring therapy of a tumor treated with a hypoxia-activated agent, harvesting of the tumor tissue from the subject can be performed before, during or after the subject has received one or more treatments with a hypoxia-activated agent.

Assays for use in the methods provided herein are those in which HA present in the sample is detected using histochemistry or immunohistochemistry.

Histochemistry (HC) is a staining method based on enzymatic reactions using a binding partner, such as an antibody (e.g., monoclonal or polyclonal antibodies) or other binding partner, to detect cells or specific proteins such as tissue antigens, or biomarkers, for example, HA. For example, histochemistry assays for use in the methods herein include those where an HABP is used as a binding partner to detect HA associated with cells or tissues. Typically, histochemistry protocols include detection systems that make the presence of the markers visible, to either the human eye or an automated scanning system, for qualitative or quantitative analyses. In a direct HC assay, binding is determined directly upon binding of the binding partner (e.g., first antibody) to the tissue or biomarker due to the use of a labeled reagent. In an indirect HC assay, a secondary antibody or second binding partner is necessary to detect the binding of the first binding partner, as it is not labeled.

In such methods, generally a slide-mounted tissue sample is stained with a labeled binding reagent (e.g., labeled HABP) using common histochemistry techniques. Thus, in exemplary HC methods provided herein, the HABP reagent is modified to contain a moiety capable of being detected (as described above). In some examples, the HABP reagent is conjugated to a small molecule, e.g., biotin, that is detected via a labeled binding partner or antibody. In some examples, the IHC method is based on staining with an HABP protein that is detected by enzymatic staining with horseradish peroxidase. For example, the HABP can be biotinylated and detected with avidin or streptavidin conjugated to detectable protein, such as streptavidin-horseradish peroxidase. In other examples, the HABP can be conjugated to detectable proteins that permit direct detection, such as, for example, HABP conjugated to a fluorescent protein, bioluminescent protein or enzyme. Various enzymatic staining methods are known in the art for detecting a protein of interest. For example, enzymatic interactions can be visualized using different enzymes such as peroxidase, alkaline phosphatase, or different chromogens such as DAB, AEC or Fast Red. In other examples, the HABP can be conjugated to peptides or proteins that can be detected via a labeled binding partner or antibody.

In other examples, HA is detected by HC methods using an HABP described herein where the HABP is detected by labeled secondary reagents, such as labeled antibodies that recognize one or more epitopes of the HABPs, HABP link domains, or HA binding fragments thereof. In other examples, HABP reagents are detected using an anti-HABP antibody. For detecting an HABP, any anti-HABP antibody can be used so long as it binds to the HABP, HABP link domain, or HA binding fragment thereof used to detect HA. For example, for detecting TSG-6 or a TSG-6-LM, an anti-TSG-6 link module monoclonal antibody can be used, such as antibodies designated A38 and Q75 (see, Lesley et al. (2002) *J Biol Chem* 277:26600-26608). The anti-HABP antibodies can be labeled for detection or can be detected with a secondary antibody that binds the first antibody. The selection of an appropriate anti-HABP antibody is within the level of one of skill in the art.

The resulting stained specimens are each imaged using a system for viewing the detectable signal and acquiring an image, such as a digital image of the staining. Methods for image acquisition are well known to one of skill in the art. For example, once the sample has been stained, any optical or non-optical imaging device can be used to detect the stain or biomarker label, such as, for example, upright or inverted optical microscopes, scanning confocal microscopes, cameras, scanning or tunneling electron microscopes, canning probe microscopes and imaging infrared detectors. In some examples, the image can be captured digitally. The obtained images can then be used for quantitatively or semi-quantitatively determining the amount of HA in the sample. Various automated sample processing, scanning and analysis systems suitable for use with immunohistochemistry are available in the art. Such systems can include automated staining and microscopic scanning, computerized image analysis, serial section comparison (to control for variation in the orientation and size of a sample), digital report generation, and archiving and tracking of samples (such as slides on which tissue sections are placed). Cellular imaging systems are commercially available that combine conventional light microscopes with digital image processing systems to perform quantitative analysis on cells and tissues, including immunostained samples. See, e.g., the CAS-200 system (Becton, Dickinson & Co.). In particular, detection can be made manually or by image processing techniques involving computer processors and software. Using such software, for example, the images can be configured, calibrated, standardized and/or validated based on factors including, for example, stain quality or stain intensity, using procedures known to one of skill in the art (see e.g., published U.S. Patent Publication No. US20100136549).

The image can be quantitatively or semi-quantitatively analyzed and scored based on staining intensity of the sample. Quantitative or semi-quantitative histochemistry refers to method of scanning and scoring samples that have undergone histochemistry, to identify and quantitate the presence of a specified biomarker, such as an antigen or other protein (e.g., HA). Quantitative or semi-quantitative methods can employ imaging software to detect staining densities or amount of staining or methods of detecting staining by the human eye, where a trained operator ranks results numerically. For example, images can be quantitatively analyzed using a pixel count algorithms (e.g., Aperio Spectrum Software, Automated QUantitatative Analysis platform (AQUA® platform), and other standard methods that measure or quantitate or semi-quantitate the degree of staining; see e.g., U.S. Pat. No. 8,023,714; U.S. Pat. No. 7,257,268; U.S. Pat. No. 7,219,016; U.S. Pat. No. 7,646,905; published U.S. Patent Publication No. US20100136549 and 20110111435; Camp et al. (2002) *Nature Medicine*, 8:1323-1327; Bacus et al. (1997) *Analyt Quant Cytol Histol*, 19:316-328). A ratio of strong positive stain (such as brown stain) to the sum of total stained area can be calculated and scored.

Using histochemical, such as immunohistochemical or pseudo immunohistochemical methods, the amount of HA detected is quantified and given as a percentage of HA positive pixels and/or a score. For example, the amount of HA detected in the sample can be quantified as a percentage of HA positive pixels. In some examples, the amount of HA present in a sample is quantified as the percentage of area stained, e.g., the percentage of HA positive pixels. For example, a sample can have at least or about at least or about 0, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 40%, 45%, 50%, 55%, 60%, 65%, 70%, 75%, 80%, 85%, 90%, 95% or more HA positive pixels as compared to the total staining area.

In some examples, a score is given to the sample that is a numerical representation of the intensity or amount of the histochemical staining of the sample, and represents the amount of target biomarker (e.g., HA) present in the sample. Optical density or percentage area values can be given a scaled score, for example on an integer scale, for example, 0-10, 0-5, or 0-3. In particular examples, the amount of hyaluronan in a sample is classified on a scale of 0-3, e.g., 0, $HA^{+1}$, $HA^{+2}$, and $HA^{+3}$. The amount of HA present is relative to the percentage of HA pixels, that is, low percentages of HA pixels indicates a low level of HA whereas high percentages of HA pixels indicate high levels of HA. Scores can correlated with percentages of HA positive pixels, such that the percentage area that is stained is scored as 0, $HA^{+1}$, $HA^{+2}$, and $HA^{+3}$, representing no staining, less than 10% staining, 10-25% staining or more than 25% staining respectively. For example, if the ratio (e.g., strong pixel stain to total stained area) is more than 25% the tumor tissue is scored as $HA^{+3}$, if the ratio is 10-25% of strong positive stain to total stain the tumor tissue is scored as $HA^{+2}$, if the ratio less than 10% of strong positive stain to total stain the tumor tissue is scored as $HA^{+1}$, and if the ratio of strong positive stain to total stain is 0 the tumor tissue is scored as 0. A score of 0 or $HA^{+1}$ indicates low levels of HA in the tested sample, whereas a score of $HA^{+2}$ or $HA^{+3}$ indicates higher levels of HA in the tested samples.

ii. Solid Phase Binding Assays

The methods of assessing hyaluronan accumulation are based on the ability of an HABP to bind to HA in a sample such that the amount of the HABP that binds correlates with amount of HA in the sample. In particular solid-phase binding assays can be used. Exemplary of binding assays that can be used to assess, evaluate, determine, quantify and/or otherwise specifically detect hyaluronan expression or levels in a sample include, but are not limited to, enzyme linked immunosorbent assay (ELISA), radioimmunoassay (RIA), immunoradiometric assay, fluoroassay, chemiluminescent assay, bioluminescent assay. For example, an HABP described herein in Section E can be used to detect HA using any binding assay known to one of skill in the art, including but not limited to, enzyme-linked immunosorbent assay (ELISA) or other similar immunoassay, including a sandwich ELISA or competitive ELISA assay. Exemplary methods provided herein include ELISA based methods for quantitative or semi-quantitative detection of the amount of HABP that binds to HA in a sample, such as a tumor tissue sample or fluid sample from a subject having a tumor or suspected of having a tumor. The use of solid phase binding assays can be used when HA is detected in a bodily fluid.

Patients that exhibit high levels of hyaluronan production in the tumor tissue also exhibit high levels of hyaluronan in blood. Accordingly, the methods provided herein encompass methods of predicting the responsiveness of subject to treatment with a hypoxia-activated agent, selecting subjects for treatment with a hypoxia-activated agent, or monitoring treatment with a hypoxia-activated agent including assessing the accumulation of hyaluronan in a fluid sample from a patient having a tumor or a patient suspected of having a tumor.

Fluid samples for analysis of HA production in an hypoxia-related disease or condition, such as cancer, include but are not limited to serum, urine, plasma, cerebrospinal fluid, and lymph. The subject can have or be suspected of having a cancer, such as a primary and metastatic tumors, in breast, colon, rectum, lung, stomach, ovary, cervix, uterus, testes, bladder, prostate, thyroid, lung cancer. In particular examples, the cancer is a late-stage cancer, a metastatic cancer, an undifferentiated cancer, ovarian cancer, in situ carcinoma (ISC), squamous cell carcinoma (SCC), prostate cancer, pancreatic cancer, non-small cell lung cancer, breast cancer, or colon cancer.

In exemplary methods to predict the responsiveness of subject to treatment with a hypoxia-activated agent or to select subjects for treatment with a hypoxia-activated agent, collection of a fluid sample from a subject is generally performed prior to treatment of the subject with a hypoxia-activated agent. In exemplary methods of monitoring therapy of a tumor with a hypoxia-activated agent, collection of the fluid sample from a subject can be performed before, during or after the subject has received one or more treatments with a hypoxia-activated agent. Harvesting of the fluid sample also can be performed before, during, or after the subject has undergone one or more rounds of anti-cancer therapy, such as radiation and/or chemotherapy treatment.

The fluid sample then can be assessed for the presence or amount of HA using a solid-phase binding assay. Solid-phase binding assays can detect a substrate (e.g., HA) in a fluid sample by binding of the substrate to a binding agent that is fixed or immobilized to a solid surface. A substrate specific antibody or binding protein (e.g., an HABP described herein), coupled to detectable label (e.g., an enzyme), is applied and allowed to bind to the substrate. Presence of the antibody or bound protein is then detected and quantitated. Detection and quantitation methods include, but are not limited to, colorimetric, fluorescent, luminescent or radioactive methods. The choice of detection method is dependent on the detectable label used. In some examples, a colorimetric reaction employing the enzyme coupled to the antibody. For example, enzymes commonly employed in this method include horseradish peroxidase and alkaline phosphatase. The amount of substrate present in the sample is proportional to the amount of color produced. A substrate standard is generally employed to improve quantitative accuracy. The concentration of HA in a sample can be calculated by interpolating the data to a standard curve. The amount of HA can be expressed as a concentration of fluid sample.

In an exemplary method, an HABP reagent that is generally unlabeled is first immobilized to a solid support (e.g., coated to wells of a microtiter plate), followed by incubation with a fluid sample containing HA (e.g., serum or plasma) to capture HA. After washing the fluid sample with an appropriate buffer, bound HA can be detected. In some examples to detect the bound HA, a second HABP that is the same or different than the immobilized HABP and that is labeled (labeled HABP), such as a biotinylated HABP, is used to bind to the HA on the plate. Following removal of the unbound labeled HABP, the bound labeled HABP is detected using a detection reagent. For example, biotin can be detected using an avidin detection reagent. In some examples, the HABP bound to the plate is different from the HABP used for detection. In other examples, the HABP bound to the plate and the HABP for detection are the same. In other examples to detect the bound HA, bound HA is detected by addition of HABP and subsequent addition of an anti-HABP antibody. For example, for detecting TSG-6 or a TSG-6-LM, an anti-TSG-6 link module monoclonal antibody can be used, such as anti-bodies designated A38 and Q75 (see, Lesley et al. (2002) *J Biol Chem* 277:26600-26608). The anti-HABP antibodies can be labeled for detection or can be detected with a secondary antibody that binds the first antibody. In yet other examples to detect the bound HA, bound HA is directly detected with an anti-HA antibody. Anti-HA antibodies are well known to one of skill in the art, and include, for example, a sheep anti-hyaluronic acid polyclonal antibody (e.g., Abcam #53842 or #93321).

iii. In Vivo Imaging Assays

In some examples herein, the amount of HA is detected using in vivo imaging methods. In such methods, the HABP, such as a TSG-6-LM, multimer (e.g., TSG-6-LM-Fc) or variant thereof, is conjugated to a detectable moiety or moiety that is capable of detection by an imaging method. Exemplary imaging methods include, but are not limited to, fluorescence imaging, X-rays, magnetic resonance methods, such as magnetic resonance imaging (MRI) and magnetic resonance spectroscopy (MRS), and tomographic methods, including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography. For example, for fluorescence imaging, fluorescent signals can be analyzed using a fluorescent microscope or fluorescence stereomicroscope. Also, a low light imaging camera also can be used.

In particular, the HABP, such as a TSG-6-LM, multimer (e.g., TSG-6-LM-Fc) or variant thereof, is labeled or conjugated with a moiety that provides a signal or induces a signal that is detectable in vivo, when imaged, such as, but not limited to, magnetic resonance imaging (MRI), single-photon emission computed tomography (SPECT), positron emission tomography (PET), scintigraphy, gamma camera, a β+ detector, a γ detector, fluorescence imaging and bioluminescence imaging. Exemplary imaging/monitoring methods include any of a variety magnetic resonance methods such as magnetic resonance imaging (MRI) and magnetic resonance spectroscopy (MRS), and also include any of a variety of tomographic methods including computed tomography (CT), computed axial tomography (CAT), electron beam computed tomography (EBCT), high resolution computed tomography (HRCT), hypocycloidal tomography, positron emission tomography (PET), gamma rays (after annihilation of a positron and an electron in PET scanning), single-photon emission computed tomography (SPECT), spiral computed tomography and ultrasonic tomography. Other exemplary imaging methods include low-light imaging, X-rays, ultrasound signal, fluorescence absorption and bioluminescence. In addition; the proteins can be labeled with light-emitting or other electromagnetic spectrum-emitting compounds, such as fluorescent compounds or molecules. Detection can be effected by detecting emitted light or other emitted electromagnetic radiation.

Detectable labels include reagents with directly detectable elements (e.g., radiolabels) and reagents with indirectly detectable elements (e.g., a reaction product). Examples of detectable labels include radioisotopes, bioluminescent compounds, chemiluminescent compounds, fluorescent compounds, metal chelates and enzymes. A detectable label can be incorporated into an HABP by chemical or recombinant methods.

Labels appropriate for X-ray imaging are known in the art, and include, for example, Bismuth (III), Gold (III), Lanthanum (III) or Lead (II); a radioactive ion, such as $^{67}$Copper, $^{67}$Gallium, $^{68}$Gallium, $^{111}$Indium, $^{113}$Indium, $^{123}$Iodine, $^{125}$Iodine, $^{131}$Iodine, $^{197}$Mercury, $^{203}$Mercury, $^{186}$Rhenium, $^{188}$Rhenium, $^{97}$Rubidium, $^{103}$Rubidium, $^{99}$Technetium or $^{90}$Yttrium; a nuclear magnetic spin-resonance isotope, such as Cobalt (II), Copper (II), Chromium (III), Dysprosium (III), Erbium (III), Gadolinium (III), Holmium (III), Iron (II), Iron (III), Manganese (II), Neodymium (III), Nickel (II), Samarium (III), Terbium (III), Vanadium (II) or Ytterbium (III); or rhodamine or fluorescein.

Contrast agents are used for magnetic resonance imaging. Exemplary contrast agents include iron, gold, gadolinium and gallium. Labels appropriate for magnetic resonance imaging are known in the art, and include, for example, fluorine, gadolinium chelates, metals and metal oxides, such as for example, iron, gallium, gold, gadolinium, magnesium, $^{1}$H, $^{19}$F, $^{13}$C, and $^{15}$N labeled compounds. Use of chelates in contrast agents is known in the art. Labels appropriate for tomographic imaging methods are known in the art, and include, for example, β-emitters such as $^{11}$C, $^{13}$N, O or $^{64}$Cu or (b) γ-emitters such as $^{123}$I. Other exemplary radionuclides that can, be used, for example, as tracers for PET include $^{55}$Co, $^{67}$Ga, $^{68}$Ga, $^{60}$Cu(II), $^{67}$Cu(II), $^{99}$Tc, $^{57}$Ni, $^{52}$Fe and $^{18}$F. The reagent, such as TSG-6 or the Fc portion thereof can be conjugated to a suitable label and/or the protein can include a radiolabel in its constituent molecules.

An exemplary list of isotopes useful for the imaging methods provided herein includes, for example, $^{11}$Carbon, $^{11}$Fluorine, $^{13}$Carbon, $^{13}$Nitrogen, $^{15}$Nitrogen, $^{15}$Oxygen, $^{18}$Flourine, $^{19}$Flourine, $^{24}$Sodium, $^{32}$Phosphate, $^{42}$Potassium, $^{51}$Chromium, $^{55}$Iron, $^{59}$Iron, $^{57}$Cobalt, $^{60}$Cobalt, $^{64}$Copper, $^{67}$Gallium, $^{68}$Gallium, $^{75}$Selenium, $^{81}$Krypton, $^{82}$Rubidium, $^{89}$Strontium, $^{92}$Strontium, $^{90}$Yttirum, $^{99}$Technetium, $^{103}$Palladium, $^{106}$Ruthenium, $^{111}$Indium, $^{117}$Lutetium, $^{123}$Iodine, $^{125}$Iodine, $^{131}$Iodine, $^{133}$Xenon, $^{137}$Cesium, $^{153}$Samarium, $^{153}$Gadolinium, $^{165}$Dysprosium, $^{166}$Holmium, $^{169}$Ytterbium, $^{177}$Leutium $^{186}$Rhenium, $^{188}$Rhenium, $^{192}$Iridium, $^{198}$Gold, $^{201}$Thallium, $^{211}$Astatine, $^{212}$Bismuth and $^{213}$Bismuth. One of skill in the art can alter the parameters used in different imaging methods (MRI, for example) in order to visualize different radionuclides/metals.

Fluorescent labels also can be used. These include fluorescent proteins, fluorescent probes or fluorescent substrate. For example, fluorescent proteins can include, but are not limited to, fluorescent proteins such as green fluorescent protein (GFP) or homologs thereof or RFP; fluorescent dyes (e.g., fluorescein and derivatives such as fluorescein isothiocyanate (FITC) and Oregon Green®, rhodamine and derivatives (e.g., Texas red and tetramethyl rhodamine isothiocyanate (TRITC)), biotin, phycoerythrin, AMCA, Alexa Fluor®, Li-COR®, CyDyes® or DyLight® Fluors); tdTomato, mCherry, mPlum, Neptune, TagRFP, mKate2, TurboRFP and TurboFP635 (Katushka). The fluorescent reagent can be chosen based on user desired excitation and emission spectra. Fluorescent substrates also can be used that result in fluorescent cleavage products.

The in vivo imaging methods can be used in the diagnosis of hypoxia-associated tumors or cancers. Such a technique permits diagnosis without the use of biopsy. In vivo imaging methods based on the extent or level of binding of an HABP to a tumor also can be used for prognoses to cancer patients. The in vivo imaging methods also can be used to detect metastatic cancers in other parts of the body or circulating tumor cells (CTCs). It is within the level of one of skill in the art to ascertain background levels of hyaluronan in tissues other than tumors. Hyaluronan-expressing tumors will have higher levels of signal than background tissues. In some examples, threshold criteria can be determined by comparisons to signal detected in normal or healthy subjects.

2. Classification of Subjects

Once the amount of a hyaluronan-associated marker, such as HA, in the sample is determined, the amount can be compared to a control or threshold level. The control or threshold level is generally a predetermined threshold level or amount that is indicative of hypoxia. Such level or amount can be empirically determined by one skilled in the art. It is understood that the particular predetermined selection or classification criteria for the methods herein are dependent on the particular assay that is used to detect hyaluronan and the particular sample that is being tested. It is within the level of one of skill in the art to determine if an assay is compatible with testing a particular sample. Generally, in vitro solid phase assays are used for testing body fluid samples. Solid phase assays such as histochemistry or immunohistochemistry are generally used for testing tissue samples. It also is understood that in methods involving comparisons to a predetermined level or amount or to a control or reference sample that the references are made with the same type of sample and using the same assay and HABP reagent (including the same detectable moiety and detecting method).

For example, the predetermined threshold level can be determined based on the level or amount of the marker in a reference or control sample, such as the median or mean level or amount of the marker in a population of subjects, in order to assess differences in levels or expression. In one example, the predetermined threshold level can represent the mean or median level or amount of a hyaluronan-associated marker (e.g., hyaluronan) in a sample from a healthy subject or a subject known to have a hypoxia-related disease or condition. In one embodiment, the level of expression for a hyaluronan-associated marker (e.g., HA) from a normal tissue or bodily fluid sample is the mean level of expression observed in normal samples (e.g., all normal samples analyzed). In another embodiment, the level of expression for HA expression from a normal tissue or bodily fluid sample is the median value for the level of expression observed in normal samples. The predetermined threshold level also can be based on the level or amount of a hyaluronan-associated marker in a cell line or other control sample, and in particular in a known hypoxic cell line (e.g., tumor cell line exhibiting features of hypoxia). As described below, these predetermined values can be determined by comparison or knowledge of HA levels in a corresponding normal sample as determined by the same assay of detection and using the same HABP reagent.

The reference or control sample can be another tissue, cell or body fluid, such as a normal tissue, cell or body fluid, for example, a tissue, cell or body fluid that is analogous to the sample being tested, but isolated from a different subject. The control or reference subject can be a subject or a population of subjects that is normal (i.e., does not have a disease or condition), a subject that has a disease but does not have the type of disease or condition that the subject being tested has or is suspected of having, for example, a subject that does not have a hypoxia-related disease or condition, or an analogous tissue from another subject that has a similar disease or condition, but whose disease is not as severe and/or expresses relatively less hyaluronan. For example, when the cell, tissue or fluid being tested is a subject or a population of subjects having a cancer, the level or amount of the marker can be compared to the level or amount of the marker in a tissue, cell or fluid from a subject having a less severe cancer, such as an early stage, differentiated or other type of cancer. In another example, a control or reference sample is a fluid, tissue, extract (e.g., cellular or nuclear extract), nucleic acid or peptide preparation, cell line, biopsy, standard or other sample, with a known amount or relative amount of a hyaluronan-associated marker (e.g., HA), such as a sample, for example a tumor cell line, known to express relatively low levels of HA, such as exemplary tumor cell lines that express low levels of HA, for example, the HCT 116 cell line, the HT29 cell line, the NCI H460 cell line, the DU145 cell line, the Capan-1 cell line, and tumors from tumor models generated using such cell lines.

In any method herein, the level(s) of a hyaluronan-associated marker (e.g., HA levels or amount) in samples from subjects suspected or known to have a hypoxia-related disease or condition (e.g., cancer) can be determined concurrently with the determination of level(s) of the hyaluronan-associated marker (e.g., HA level or amount) in reference or normal tissues. Alternatively, the levels of a hyaluronan-associated marker (e.g., HA level or amount) in samples from subjects suspected or known to have a hypoxia-related disease or condition (e.g., cancer) can be compared to the level(s) of the hyaluronan-associated marker (e.g., HA level or amount) previously determined in normal tissue or bodily fluid. Thus, the level of a hyaluronan-associated marker (e.g., HA level or amount) in normal or healthy samples or other reference samples employed in any detection, comparison, determination, or evaluation can be a level or amount determined prior to any detection, determination, or evaluation of the level of expression of the hyaluronan-associated marker (e.g., HA) in a sample from a human patient.

The level of expression of the hyaluronan-associated marker (e.g., HA) is determined and/or scored and compared to predetermined phenotypes of the hyaluronan-associated marker (e.g., HA) associated with hypoxic disease. It is within the level of one of skill in the art to determine the threshold level for disease diagnosis depending on the particular disease, the assay being used for detection of the hyaluronan-associated marker (e.g., HA) and/or the HABP detection reagent being used. It is within the level of one of skill in the art to determine the threshold level of the hyaluronan-associated marker (e.g., HA) for classifying responsiveness to treatment with a hypoxia-activated agent. Exemplary methods for stratification of tumor samples or bodily fluid samples for diagnosis, prognosis or selection of subjects for treatment are provided herein.

It is understood that the particular change, e.g., increase in or decrease of a hyaluronan-associated marker (e.g., HA), is dependent on the assay used. In an ELISA, the fold increase or decrease in absorbance at a particular wavelength or in quantity of protein (e.g., as determined by using a standard curve) can be expressed relative to a control. In a PCR assay, such as RT-PCR, sample expression levels can be compared to control expression levels (e.g., expressed as fold change) using methods known to those in the art, such as using standards.

In particular examples of the methods herein, a subject is selected as a candidate for therapy with a hypoxia-activated agent if the amount of hyaluronan-associated marker (e.g., HA) is determined to be elevated in the sample. The hyaluronan-associated marker can be hyaluronan. For example, elevated or accumulated hyaluronan levels in a diseased subject compared to a healthy or normal subject is indicative of a hypoxia-related disease or condition (e.g., tumor hypoxia). The hyaluronan can be elevated 0.5-fold, 1-fold, 2-fold, 3-fold, 4-fold, 5-fold, 6-fold, 7-fold, 8-fold, 9-fold, 10-fold or more. Thus, in examples of the methods herein, when the amount of hyaluronan in a sample from a subject is being tested, detection of the marker can be determining that the amount of HA in the sample (e.g., cancerous cell, tissue or fluid) from the subject is elevated compared to a predetermined level or amount or control sample. In one example, the subject is determined to have a hypoxia-associated disease or condition if the amount of HA in the tissue, cell or fluid is elevated at or about 0.5-fold, 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 20-fold, or more, compared to the predetermined level or amount or control sample.

A subject can be selected as a candidate for therapy with a hypoxia-activated agent based on the level or amount of hyaluronan in a sample (e.g., a bodily fluid or other fluid) from the subject. HA greater than 0.010 µg/mL, 0.015 µg/mL, and generally greater than 0.02 µg/mL, 0.03 µg/mL, 0.04 µg/mL, 0.05 µg/mL, 0.06 µg/mL or higher correlates to the presence of a hypoxic tumor or cancer. Using such methods, in exemplary methods provided herein, a subject can be selected for treatment with a hypoxia-activated agent if the concentration of HA in the fluid sample, such as a serum sample, contains HA levels greater than 0.010 µg/mL, 0.015 µg/mL, and generally greater than 0.02 µg/mL, 0.03 µg/mL, 0.04 µg/mL, 0.05 µg/mL, 0.06 µg/mL or higher.

A subject can be selected as a candidate for therapy with a hypoxia-activated agent based on the level or amount of hyaluronan in a cell or tissue sample. In such an example, if the level is indicative of disease, then the patient is diagnosed with a hypoxia-related disease or condition. For example, using immunohistochemistry methods of tumor tissues a score of $HA^{+2}$ or $HA^{+3}$ can be determinative of disease. For example, a percentage of staining of HA over total tumoral area of greater than 10%, such as 10 to 25%, or greater than 25% is indicative of disease. In the methods herein, a subject is selected for treatment with a hypoxia-activated agent if the scaled score of the sample is an $HA^{+2}$ or $HA^{+3}$ sample. For example, a high score, e.g., $HA^{+3}$, indicates the subject has an HA-rich tumor indicative of hypoxia and would benefit from treatment with a hypoxia-activated agent and thus is a candidate for therapy with a hypoxia-activated agent. In other examples, a subject can be selected for treatment with a hypoxia-activated agent based on the percentage of staining, for example, if the degree of HA staining is 10%, 15%, 20%, 25%, 30%, 35%, 40%, 45%, 50%, 55%, 60%, 65%, 70%, 75%, 80%, 85%, 90%, 95% or more of the total staining area, and generally at least 25% or more.

Efficacy of treatment with a hypoxia-activated agent or responsiveness to treatment also can be monitored by comparing the level or amount of a hyaluronan-associated marker in a subject over time. Changes in the level or amount of a hyaluronan-associated marker (e.g., HA levels) can be used to optimize dosing or scheduling of treatment with a hypoxia-activated agent. In other methods, treatment is monitored by comparing HA levels in a subject with those of a healthy or normal subject. Dosing and scheduling of treatment can be modified in response to changing levels. For example, if the hyaluronan-associated marker (e.g., hyaluronan) level is about the same as or below (or decreased) as compared reference or control sample, the treatment is likely efficacious and the treatment can be continued or discontinued or altered. Combination therapy using non-hypoxia-activated agents also can be employed in such treatment methods. It is within the level of the skill of the treating physician to determine the exact course of treatment. For example, the treatment can be altered, such that the dosing amount, schedule (e.g frequency of administration), or regime is adjusted accordingly, such as discontinued, decreased or made less frequent, or combined with another treatment for the disease or condition. On the other hand, if the hyaluronan-associated marker (e.g hyaluronan) level is above a compared reference or control sample, the patient is likely not responding to the treatment. In such instances, the particular nature and type of hypoxia-activated agent or combination therapy can be modified or changed. In other instances, the dosing, amount, schedule and/or regime can be adjusted accordingly, such as increased or made more frequent. It is within the level of the treating physician to determine the exact course of treatment.

For purposes of monitoring efficacy of treatment, predetermined levels or amounts of a hyaluronan-associated marker (e.g., HA) can be empirically determined, whereby the level or amount indicates that the treatment is working. As described below, these predetermined values can be determined by comparison or knowledge of HA levels in a corresponding normal sample or samples of disease subjects as determined by the same assay of detection and using the same HABP reagent. For example, high levels of HA as assessed by immunohistochemistry methods using a quantitative score scheme (e.g., $HA^{+3}$) or percentage of tumor staining for hyaluronan of greater than 25% correlate to the existence of malignant disease across a range of cancer types, and indicate that a patient is not responding to treatment. In another example, HA levels in bodily fluid such as plasma of greater than 0.015 µg/mL, and generally greater than 0.02 µg/mL, such as 0.03 µg/mL, 0.04 µg/mL, 0.05 µg/mL or 0.06 µg/mL HA, is associated with advanced disease stage. On the other hand, a subject is likely responding to treatment if the scaled score of the sample is less than an $HA^{+2}$ or $HA^{+3}$ or the percentage of HA staining is less than 25%, 20%, 15%, 10%, 9%, 8%, 7%, 6%, 5%, 4%, 3%, 2% or less. A subject is likely responding to treatment if the HA level in bodily fluid such as plasma is less than 0.03 µg/mL, 0.02 µg/mL, 0.01 µg/mL or less.

In the methods herein, the comparison to a predetermined level or to levels of a control or reference sample can be determined by any method known of skill in the art. For example, the comparison of the level of hyaluronan with a reference, control or predetermined level can be done by an automated system, such as software program or intelligence system that is part of, or compatible with, the equipment (e.g., computer platform) on which the assay is carried out. Alternatively, this comparison can be done by a physician or other trained or experienced professional or technician.

D. HYALURONAN BINDING PROTEINS (HABPS) FOR USE AS A DIAGNOSTIC OF HYPOXIA

As described herein, cells or tissues, such as tumors, that express elevated or high levels of a hyaluronan exhibit hypoxia and thus are responsive to treatment with a hypoxia-activated agent. Accordingly, the methods provided herein are directed to quantitative or semi-quantitative measurement of hyaluronan in a sample, such as a tumor or fluid sample from a subject having a tumor or suspected of having a tumor, using a hyaluronan binding protein (HABP). An HABP can include any protein, peptide or other reagent capable of specifically binding hyaluronan, including an anti-HA antibody or a protein or peptide containing a hyaluronan-binding domain. The HABPs provided for use in the methods herein, in concert with the assays for detection thereof described below, permit specific and sensitive detection of HA in samples, and hence identification of hypoxic cells or tissues. The HABP diagnostics can be used in conjunction with hypoxia-activated agent therapy (described in Section E) to select or identify patients predicted to be responsive to treatment and/or to monitor treatment and efficacy of treatment, thereby providing an improved treatment regimen of hypoxia-related diseases and conditions.

The hyaluronan-binding proteins for use in the methods provided herein for the detection and quantitation of hyaluronan in a sample can contain full length HABP polypeptides, or sufficient portions thereof to specifically bind HA. Exemplary of such HABPs are described in U.S. Provisional Application Nos. 61/628,187; 61/559,011; and 61/630,765). Typically, the HABPS or portions thereof, for example HABPs containing an HA binding domain or sufficient portion thereof that bind HA, or variants or multimers thereof exhibit with a binding affinity represented by the dissociation constant (Kd) of less than $1 \times 10^{-7}$ M, and generally less than $1 \times 10^{-8}$ M, $2 \times 10^{-8}$ M, $3 \times 10^{-8}$ M, $4 \times 10^{-8}$ M, $5 \times 10^{-8}$ M, $6 \times 10^{-8}$ M, $7 \times 10^{-8}$ M, $8 \times 10^{-8}$ M, $9 \times 10^{-8}$ M, $1 \times 10^{-9}$ M, $2 \times 10^{-9}$ M, $3 \times 10^{-9}$ M, $4 \times 10^{-9}$ M, $5 \times 10^{-9}$ M, $6 \times 10^{-9}$ M, $7 \times 10^{-9}$ M, $8 \times 10^{-9}$ M, $9 \times 10^{-9}$ M or lower. The exhibited binding affinity is generally exhibited under conditions that achieve optimal or close to optimal binding to hyaluronan. In one example, pH conditions can affect binding. For example, binding assays using a TSG-6 reagent, including TSG-6-LM or sufficient portions thereof to bind HA, variants thereof and multimers thereof, are generally conducted at a pH of at or about between pH 5.8 to 6.4, such as about or pH 6.0.

Hyaluronan binding proteins containing an HA binding domain or sufficient portion thereof that bind HA are of two types: hyaluronan binding proteins that have an HA binding domain that contains one or two link modules, and hyaluronan binding proteins that have an HA binding domain that is not a link module. In particular examples, the HABP used in the methods herein are derived from HABP binding molecules that have only a single link domain that confers HA binding, which can simplify expression, production and purification methods.

The HABPs provided herein can be derived from known HABPs or can be generated synthetically. In some examples, HABPS can be generated synthetically based on conserved residues of HA-binding domains of known HABPs. HABPs provided herein also can be derived from HABPs generated from screening methods for HA binding proteins, such as phage display or affinity-based screening methods.

The HABPs, including HA binding domains of HABPs, or portions thereof that are sufficient to bind to HA, for use in the methods provided herein can be modified to improve one or more properties of HABPs. For example, the HABPs, or HA binding fragments thereof, provided herein can be modified to increase protein expression in mammalian expression systems, improve biophysical properties such as stability and solubility, improve protein purification and detection, increase specificity for HA and/or increase affinity to HA, as long as they retain their ability to bind to HA. For example, an HABP or HA binding fragment thereof provided herein for use in the methods can be modified to increase its specificity for hyaluronan compared to other glycosaminoglycans. In another example, an HABP or HA binding fragment thereof provided herein for use in the methods can be linked directly or indirectly to a multimerization domain to increase the number of HA binding sites on the molecule and therefore increase the affinity for binding to HA.

Further, for use in the methods herein, any of the HABPs, or portions thereof (e.g., link modules or sufficient portions thereof to bind HA) can be modified to facilitate detection. For example, the HABP can be modified by conjugation, directly or indirectly, to biotin, a fluorescent moiety, a radiolabel or other detectable label.

1. HA Binding Proteins with Link Modules or G1 Domains

The HA binding proteins (HABP) or portions thereof for use in the methods herein contain at least one link module or link domain, and generally at least two or more link modules. In some examples, the HABP contains a G1 domain that contains two link modules. Binding to HA is mediated via the link module. Link modules, also called proteoglycan tandem repeats, are approximately 100 amino acids (aa) in length with four cysteines that are disulfide bonded in the pattern Cys1-Cys4 and Cys2-Cys3. The three dimensional structure of the link modules are composed of two alpha-helices and two triple stranded anti-parallel beta-sheets.

There are three categories of link module-containing proteins: A domain-type proteins that contain a single link module; B domain-type proteins that contain a single link module extended by an N- and a C-terminal flanking region; and C domain-type proteins that have an extended structure called a G1 domain that contains one N-terminal V-type Ig-like domain followed by a contiguous pair of two link modules. Modeling and comparison studies have demonstrated a high degree of resolution and conservation of certain amino acids between and among link module-containing proteins that correlate to interaction with HA (Blundell et al. (2005) *J. Biol. Chem.*, 280:18189-18201). For example, central HA-binding amino acid residues corresponding to Tyr59 and Tyr78 with numbering with reference to TSG-6-LM set forth in SEQ ID NO:360 are conserved among link-module-containing HABPs via identical or conservative amino acids (e.g., aromatic or large and planar faced hydrophobic residues that can also stack against a GlcNAc ring, e.g., Phe, His, Leu or Val) at the corresponding position based on alignment with TSG-6-LM (e.g., set forth in SEQ ID NO:360). Also, basic residues at positions corresponding to positions 11 and 81 set forth in SEQ ID NO:360 also are found in other link modules as determined by alignment.

HA binding proteins containing link modules for use in the methods provided herein include, but are not limited to, TSG-6 (e.g., set forth in SEQ ID NO:206 as the precursor and in SEQ ID NO:222 as the mature protein lacking a signal sequence; or the LM set forth in SEQ ID NOS: 207, 360, 417 or 418, which represent various lengths of the LM as reported in the literature), stabilin-1 (e.g., set forth in SEQ ID NO:223 or the mature form thereof; or the LM set forth in SEQ ID NO:371), stabilin-2 (e.g., set forth in SEQ ID NO:224 or the mature form thereof; or the LM set forth in SEQ ID NO:372), CD44 (e.g., set forth in SEQ ID NO:227 or the mature form thereof; or the LM set forth in SEQ ID NO:375), LYVE-1 (e.g., set forth in SEQ ID NO:228 or the mature form thereof; or the link module set forth in SEQ ID NO:376), HAPLN1 (e.g., HAPLN1-1 and HAPLN1-2; e.g., set forth in SEQ ID NO:229 or the mature form thereof; or the LM or LMs set forth in SEQ ID NO:377 or 378), HAPLN2 (e.g., HAPLN2-1 and HAPLN2-2; e.g., set forth in SEQ ID NO:230 or the mature form thereof; or the LM or LMs set forth in SEQ ID NO:379 or 380), HAPLN3 (e.g., HAPLN3-1 and HAPLN3-2; e.g., set forth in SEQ ID NO:231 or the mature form thereof; or the LM or LMs set forth in SEQ ID NO:381 or 382), HAPLN4 (e.g., HAPLN4-1 and HAPLN4-2; e.g., set forth in SEQ ID NO:232 or the mature form thereof; or the LM or LMs set forth in SEQ ID NO:383 or 384), aggrecan (e.g., aggrecan 1, aggrecan 2, aggrecan 3 and aggrecan 4; e.g., set forth in SEQ ID NO:233 or the mature form thereof; or the LM or LMs set forth in SEQ ID NO:385, 386, 387 or 388), versican (e.g., versican 1 and versican 2; e.g., set forth in SEQ ID NO:235 or the mature form thereof; or the LM or LMs set forth in SEQ ID NO:391 or 392), brevican (e.g., brevican 1 and brevican 2; e.g., set forth in SEQ ID NO:234 or the mature form thereof; or the LM or LMs set forth in SEQ ID NO:389 or 390), neurocan (e.g., neurocan 1 and neurocan 2; e.g., set forth in SEQ ID NO:236 or the mature form thereof; e.g., the LM or LMs set forth in SEQ ID NO:393 or 394) and phosphacan (e.g., set forth in SEQ ID NO:340 or the mature form thereof). Exemplary of an HABP provided for use in the methods herein is TSG-6.

In particular examples herein, the HABP used in the methods herein contains at least one link module, and generally contains at least two or at least three link modules. The HABP can be a full-length HABP containing a link module. For example, the HABP reagent for use in the method herein can contain a sequence of amino acids set forth in any of SEQ ID NOS: 206, 222 and 223-236, the mature form thereof, or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 206, 222 and 223-236. For example, the HABP for use in the methods herein can be a full-length TSG-6 having a sequence of amino acids set forth in SEQ ID NO:222, or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in SEQ ID NO:222.

In other examples, the HABP for use in the methods herein contains only the link module or sufficient portion of a link module to bind to HA derived from a full-length HABP set forth in any of SEQ ID NOS: 206, 222 and 223-236 or the mature form thereof. In some examples, the HABP containing a link module or modules is not the complete sequence of an HABP set forth in any of SEQ ID NOS: 206, 222 and 223-236 or the mature form thereof. It is understood that the portion of an HABP or link module is generally a contiguous sequence of amino acids that is generally at least 50 amino acids in length, 60, 70, 80, 90, 100, 200, 300 or more amino acids. In some examples, the link module or modules is the only HABP portion of the binding molecule. For example, the HABP for use in the method herein contains only a portion of a full-length HABP having the sequence of amino acids set forth in any of SEQ ID NOS: 207, 222, 360, 361, 371-394 and 416-418 or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 207, 222, 360, 361, 371-394 and 416-418.

In examples herein, the HABP for use in the methods herein contains a G1 domain or sufficient portion thereof to bind specifically bind to HA. The HABP containing the G1 domain can be derived from a full-length HABP set forth in any of SEQ ID NOS: 233-236 or the mature form thereof. In some examples, the HABP containing the G1 domain is not the complete sequence of an HABP set forth in any of SEQ ID NOS: 233-236 or mature form thereof. It is understood that the portion of an HABP containing a G1 domain is generally a contiguous sequence of amino acids that is generally at least 100 amino acids in length, such as 150, 200, 250, 300, 400, or more amino acids. In some examples, the G1 domain is the only HABP portion of the companion diagnostic binding molecule. For example, the HABP for use in the method herein contains only a portion of a full-length HABP that has a G1 domain having a sequence of amino acids set forth in any of SEQ ID NOS: 423-426 or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 423-426.

In some examples, the HABP can contain more than one link module, such as two or three link modules. The link modules can be from the same or different HABP. The HABP can contain link modules that are linked directly or indirectly to form a single polypeptide. In other examples, the HABP can contain link modules that are set forth as separate polypeptides that are chemically linked, such as via a disulfide bond. Exemplary of an HABP fragment provided for use in the methods herein is the link domain of TSG-6 (TSG-6-LM), or a portion thereof sufficient to bind to HA.

In some examples, the HABP is a multimer containing two or more link modules that are linked directly or indirectly via a multimerization domain to effect the formation of dimer or trimer molecules and the generation of multiple HA binding sites. For example, an HAPB for use in the methods herein is one that is generated by expression of a nucleic acid molecule encoding the link module set forth in any one of SEQ ID NOS: 207, 360, 361, 371-394 and 416-418 or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 207, 360, 361, 371-394 and 416-418 linked directly or indirectly to a nucleic acid encoding a multimerization domain, such as an Fc portion of an immunoglobulin. Hence, the resulting HABP multimer or LM-multimer contains a first polypeptide set forth in any one of SEQ ID NOS: 207, 360, 361, 371-394 and 416-418 or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 207, 360, 361, 371-394 and 416-418 linked directly or indirectly to a multimerization domain; and a second polypeptide set forth in any one of SEQ ID NOS: 207, 360, 361, 371-394 and 416-418 or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 207, 360, 361, 371-394 and 416-418 linked directly or indirectly to a multimerization domain. The sequence of the link module in the first and second polypeptide can be the same or different. Exemplary of an HABP multimer provided for use in the methods herein is a multimer containing two polypeptide chains, whereby each contains the TSG-6-LM, variant thereof or sufficient portion thereof to bind HA linked directly or indirectly to a multimerization domain that effects multimerization. For example, provided herein for use in the methods is a TSG-6-LM-Fc molecule (see e.g., SEQ ID NO:212 or 215).

A description of exemplary HABPs containing link domains, including structure and function description, is provided below. Any of the described HABPs or portions thereof, such as a fragment containing only a link domain or sufficient portion thereof to bind HA, can be used as a reagent in the methods herein. It is understood that reference to amino acids, including to a specific sequence set forth as a SEQ ID NO used to describe domain organization of a link domain or other domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each HABP. Hence, the specific domain, such as specific link domain, can be several amino acids (one, two, three or four) longer or shorter.

a. Type A: TSG-6 Sub-Group

HABPs for use in the methods herein are HABPs that are members of the Type A sub-group that contain a single link module that binds to hyaluronan. Type A HABPs bind to HA with a minimum chain length of six sugars, hexasaccharide ($HA_6$), or greater. Members of the Type A sub-group that can be used in the methods provided herein include, but are not limited to, TSG-6, Stabilin-1, Stabilin-2, CAB61358 and KIAA0527, link modules thereof, or sufficient portions of a link module that binds HA.

i. TSG-6

Exemplary of a Type A sub-group HABP provided for use in the methods provided herein is TSG-6, or a link module thereof, a sufficient portion of a link module to bind to HA, variants thereof or multimers thereof. Tumor necrosis factor-Stimulated Gene-6 (TSG-6, tumor necrosis factor alpha-induced protein 6, TNFAIP6; SEQ ID NO:206) is a ~35 kDa secreted glycoprotein composed of a single N-terminal link module and C-terminal CUB domain. Expression of TSG-6 is induced in many cell types by inflammatory mediators, including cytokines and growths factors. Via its link module, TSG-6 is a potent inhibitor of polymorphonuclear leukocyte migration. TSG-6 forms a stable complex with the serine protease inhibitor Inter-alpha-Inhibitor (IαI) and potentiates the anti-plasmin activity of IαI. TSG-6 also is important for the formation and remodeling of HA-rich pericellular coats and extracellular matrices.

The human TSG-6 transcript (SEQ ID NO:205) is normally translated to form a 277 amino acid precursor peptide (SEQ ID NO:206) containing a 17 amino acid signal sequence at the N-terminus. The mature TSG-6 (set forth in SEQ ID NO:222), therefore, is a 260 amino acid protein containing amino acids 18-277 of SEQ ID NO:206 (Lee et al. (1992) *J Cell Biol* 116:545-557). TSG-6 is composed of two main domains, the link module and the CUB domain. The link module of TSG-6 is variously reported in the literature to be located at amino acids 35-129, 36-128, 36-129 or 36-132 of SEQ ID NO:206 (set forth as SEQ ID NOS: 207, 360, 417 or 418, respectively). It is understood that reference to loci of a domain can vary by several amino acids due to differences in alignments. Hence, for purposes herein, a TSG-6-LM is one set forth in any of SEQ ID NOS: 207, 360, 417 or 418 or that varies from such sequence by one, two or three amino acids. The CUB domain is located at amino acids 135-246 of SEQ ID NO:206. Human TSG-6 has two potential N-linked glycans at residues N118 and N258 of SEQ ID NO:206. In addition, residues T259 and T262 of SEQ ID NO:206 are phosphorylated (Molina et al. (2007) *Proc Natl Acad Sci USA* 104:2199-2204). Human TSG-6 has eight native cysteines which form four disulfide bonds at residues C58-C127, C82-C103, C135-C161 and C188-C210 of preprotein TSG-6 (SEQ ID NO:206).

TSG-6 link module (SEQ ID NO:360) has a relatively small size and a well-characterized structure. The three dimensional structure of the TSG-6 link domain was determined and found to have the same fold as other known link modules, containing two alpha helices and two antiparallel beta sheets arranged around a large hydrophobic core (Kohda et al. (1996) *Cell* 86:767-775). In addition, the interaction of the link module of TSG-6 and HA has been studied revealing that the aromatic rings of Tyr12, Tyr59, Phe70, Tyr78, Trp88 and basic residues Lys11, Lys72, Asp77, Arg 81, and Glu86 of the link domain of TSG-6 (SEQ ID NO:360) are important for binding to HA (see, e.g., Kahmann et al. (2000) *Structure* 15:763-774; Mahoney et al. (2001) *J Biol Chem* 276:22764-22771; Kohda et al. (1996) *Cell*, 88:767-775; Blundell et al. (2003) *J Biol Chem* 278:49261-49270; Lesley et al. (2004) *J Biol Chem* 279:25745-25754; Blundell et al. (2005) *J Biol Chem* 280:18189-18201). Structural studies also show that there is only a single HA-binding site contained in the link module, which is localized to one region of the molecule based on the structural map of residues Lys11, Tyr12, Tyr59, Phe70 and Tyr78 that are most directly implicated in HA binding (see e.g., Mahoney et al. (2001) *J Biol Chem* 276: 22764-22771).

The link module of TSG-6 exhibits binding activity to several glycosaminoglycans. For example, studies have revealed binding of the link module to HA, chondroitin-4-sulphate (C4S), G1-domain of the proteoglycan aggrecan, heparin and the bikunin chain of IαI (see e.g., Milner et al. (2003) *Journal of Cell Science*, 116:1863-1873; Mahoney et al. (2005) *Journal of Biological Chemistry*, 280:27044-27055). The binding of TSG-6 to heparin and HA is mediated by a distinct binding site in the LM of TSG-6. The residues involved in TSG-6-LM binding to hyaluronan are Lys11, Tyr12, Tyr59, Phe70 and Tyr78, whereby the mutants K11Q, Y12F, Y59F, F70V and Y78F have between 10- and 100-fold lower HA-binding affinity compared to wildtype; the residues in the TSG-6-LM involved in binding to heparin are Lys20, Lys34, Lys41, Lys54, Arg56 and Arg84, whereby the mutants K20A, K34A, K41A and K54A exhibit impaired heparin binding properties; and the residues involved in TSG-6-LM binding to bikunin is overlapping with but not identical to the HA binding site (Mahoney et al. (2005) *Journal of Biological Chemistry*, 280:27044-27055).

Binding of TSG-6 to hyaluronan is pH dependent, with binding activity exhibited at acidic pH of about or pH 5.6 to 6.4, such as or about pH 5.8 to pH 6.0.

TSG-6 polypeptides, HA binding domains thereof, e.g., TSG-6 link modules, or fragments thereof sufficient to bind to HA provided herein for use in the methods herein can include any of SEQ ID NOS: 206, 207, 222, 360, 417 or 418, or variants thereof such as variants that exhibit at least 65%, 70%, 75%, 80%, 85%, 90%, 91%, 92%, 93%, 94%, 95%, 96%, 97%, 98%, 99% or more sequence identity to any one of SEQ ID NOS: 206, 207, 222, 360, 417 or 418. Exemplary variants include, for example, species variants, allelic variants and variants that contain conservative and non-conservative amino acid mutations. Natural allelic variants of human TSG-6 include, for example, TSG-6 containing the amino acid replacement Q144R (SEQ ID NO:407, Nentwich et al. (2002) *J Biol Chem* 277:15354-15362). TSG-6 is highly conserved among species with mouse and human protein being >94% identical. Species variants of TSG-6 or HA binding fragments thereof for use as a companion diagnostic in the methods provided herein also include, but are not limited to, mouse (SEQ ID NO:252), rabbit (SEQ ID NO:253), bovine (SEQ ID NO:254), horse (SEQ ID NO:409), chimpanzee (SEQ ID NO:408), dog (SEQ ID NO:410), mouse (SEQ ID NO:411), chicken (SEQ ID NO:412), frog *Xenopus laevis* (SEQ ID NO:413), zebra fish (SEQ ID NO:414), mature forms thereof or link modules or sufficient portions thereof to bind HA.

Variants of TSG-6 or HA binding fragments thereof for use in the provided methods include variants with an amino acid modification that is an amino acid replacement (substitution), deletion or insertion. Exemplary modifications are amino acid replacements such as an amino acid replacement corresponding to replacement at any of amino acid residues 4, 6, 8, 13, 20, 29, 34, 41, 45, 54, 67, 72 or 96 with respect to the TSG-6 set forth in SEQ ID NOS: 360, 417 or 418. Corresponding amino acid residues also can be made in other TSG-6 polypeptides, for example the TSG-6 polypeptide set forth in SEQ ID NO:207, whereby the corresponding amino acid residues can be identified by alignment of the TSG-6 with any of SEQ ID NOS: 360, 417 or 418. The replacement amino acid can be to any other amino acid residue.

Exemplary amino acid replacements of a TSG-6 polypeptides or HA binding fragments thereof provided herein for use as a companion diagnostic reagent in the methods provided herein include modified TSG-6 polypeptides or HA-binding fragments thereof that contain at least one amino acid replacement corresponding to H4K, H4S, E6A, E6K, R8A, K13A, K20A, H29K, K34A, K41A, H45S, K54A, N67L, N67S, K72A, H96K, K34A/K54A or K20A/K34A/K41A with respect to the TSG-6 set forth in SEQ ID NOS: 360, 417 or 418 (see, e.g., Mahoney et al. (2005) *J Biol Chem* 280: 27044-27055, Blundell et al. (2007) *J Biol Chem* 282:12976-12988, Lesley et al. (2004) *J Biol Chem* 279:25745-25754, Kahmann et al. (2000) *Structure* 15:763-774). It is understood that residues important or otherwise required for the binding of TSG-6 to HA, such as any described above or known to one of skill in the art, are generally invariant and cannot be changed. Thus, for example, amino acid residues 11, 12, 59, 70, 78 and 81 of SEQ ID NO:360 in the link module of TSG-6 are generally invariant and are not altered. Further, it is understood that amino acid modifications that result in improper folding or perturbation of the folding of the link module are generally invariant. Thus, for example, a modified TSG-6 provided for use in the methods herein will not contain any one or more of the amino acid modifications H4S, H29A, H45A, H45K, R56A, D77A, R84A and D89A of SEQ ID NO:360 (Mahoney et al. (2005) *J Biol Chem* 280: 27044-27055, Blundell et al. (2007) *J Biol Chem* 282:12976-12988, Lesley et al. (2004) *J Biol Chem* 279:25745-25754).

In particular, the modification, for example amino acid replacement or replacements, is one that confers an altered, such as improved, activity compared to a TSG-6 not containing the modification. Such variants include those that contain amino acid modifications that enhance the binding affinity of TSG-6 to HA, increase the specificity of TSG-6 for HA, and/or increase the solubility of TSG-6. For example provided herein for use in the methods herein are TSG-6 variants, HA binding domains, or portions thereof sufficient to bind to HA that increase the specificity of TSG-6 for HA by decreasing the binding of TSG-6 to other glycosaminoglycans, including heparin, chondroitin-4-sulfate, heparan sulfate and dermatan sulfate. Binding to the other glycosaminoglycan that is not hyaluronan can be reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more compared to binding of TSG-6-LM not containing the modification. For example, provided herein is a mutant TSG-6-LM containing amino acid replacement(s) at amino acid residues 20, 34, 41, 54, 56, 72 and/or 84, and in particular at amino acid residues 20, 34, 41, and/or 54 (corresponding to amino acid residues set forth in SEQ ID NO:360). The replacement amino acid can be to any other amino acid residue, and generally is to a non-basic amino acid residue. For example, amino acid replacement can be to Asp (D), Glu (E), Ser (S), Thr (T), Asn (N), Gln (O), Ala (A), Val (V), Ile (I), Leu (L), Met (M), Phe (F), Tyr (Y) or Trp (W). The amino acid replacement or replacements confer decreased binding to heparin. For example, variants that decrease the ability of TSG-6 to bind to heparin are known to one of skill in the art. Such variants are those that include at least one mutation corresponding to K20A, K34A, K41A and K54A, including variants K34A/K54A or K20A/K34A/K41A (Mahoney et al. (2005) *J Biol Chem* 280:27044-27055). Exemplary variants that decrease or reduce binding to heparin are variant TSG-6-LM set forth in SEQ ID NO:361 or 416.

Exemplary of a TSG-6 polypeptide for use in the methods provided herein is a TSG-6 polypeptide that contains at least an HA binding domain, for example, a TSG-6 link module. Thus, provided herein is a TSG-6 link module, or variant thereof, for use in the provided methods. Exemplary of such a polypeptide reagent is one that has a sequence of amino acids set forth in SEQ ID NOS: 207, 360, 361, 416, 417 or 418, or has a sequence of amino acids that exhibits at least 65%, 70%, 75%, 80%, 85%, 90%, 91%, 92%, 93%, 94%, 95%, 96%, 97%, 95%, 99% or more sequence identity to any of SEQ ID NOS: 207, 360, 361, 416, 417 or 418. For example, the TSG-6 link module can be modified to alter its specificity, affinity or solubility, as long as it retains its ability to bind to HA.

In yet another example, the affinity and/or solubility of the TSG-6 link module is increased by dimerization or multimerization, such as, for example, by fusion to a multimerization domain, such as an Fc domain (see below). Hence, the TSG-6 link module can be modified to produce a multimer containing two or more link modules that are linked directly or indirectly via a multimerization domain to effect the formation of dimer or trimer molecules and the generation of multiple HA binding sites. For example, a TSG-6 link module as an HABP for use in the methods herein is one that is generated by expression of a nucleic acid molecule encoding the link module set forth in any one of SEQ ID NOS: 207, 360, 361, 417 or 418 or a nucleic acid encoding a link module having a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 207, 360, 361, 417 or 418 linked directly or indirectly to a nucleic acid encoding a multimerization domain, such as an Fc portion of an immunoglobulin. Hence, the resulting TSG-6-LM multimer contains a first polypeptide set forth in any of SEQ ID NOS: 207, 360, 361, 417 or 418 or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 207, 360, 361, 417 or 418 linked directly or indirectly to a multimerization domain; and a second polypeptide set forth in any one of SEQ ID NOS: 207, 360, 361, 417 or 418 or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 207, 360, 361, 417 or 418 linked directly or indirectly to a multimerization domain. Generally, the LM or sufficient portion thereof to effect HA binding is the only TSG-6 portion of the multimer. For example, provided herein for use in the methods is a TSG-6-LM-Fc molecule (see e.g., SEQ ID NO:212 or 215).

ii. Stabilin-1 and Stabilin-2

Exemplary of a Type A sub-group HABP provided for use as a companion diagnostic reagent in the methods provided herein is Stabilin-1 or Stabilin-2, or a link module thereof, a sufficient portion of a link module to bind to HA, variants thereof or multimers thereof. Stabilin-1 (also called STAB1, CLEVER-1, KIAA0246, FEEL-1, FEX-1 and FELE-1; SEQ ID NO:223) and Stabilin-2 (also called STAB2, FEEL-2, CD-44 like precursor FELL2, DKFZp434E0321, FEX2, and hyaluronan receptor for endocytosis/HARE; SEQ ID NO:224) are type I transmembrane members of a family of fasciclin-like hyaluronan (HA) receptor homologs. Both contain seven fasciclin-like adhesion domains, multiple EGF-like repeats, and hyaluronan-binding link modules. Both Stabilin-1 and Stabilin-2 are expressed on sinusoidal endothelium and macrophages, though each is functionally distinct. Stabilin-1 is involved in two intracellular trafficking pathways: receptor mediated endocytosis and recycling; and shuttling between the endosomal compartment and trans-Golgi network (TGN). Stabilin-2 acts as a scavenger receptor for HA and AGE-modified proteins.

The precursor sequence of Stabilin-1 is set forth in SEQ ID NO:223. The link module of Stabilin-1 is located at 2208-2300 of SEQ ID NO:223 and is set forth in SEQ ID NO:371. The precursor sequence of Stabilin-2 is set forth in SEQ ID NO:224 and the link module of Stabilin-2 is located at amino acids 2198-2290 of SEQ ID NO:224 and is set forth in SEQ ID NO:372.

Stabilin-1 or Stabilin-2 polypeptides, HA binding domains thereof, e.g., Stabilin-LM modules or fragments thereof sufficient to bind to HA provided for use in the methods herein include the link module set forth in SEQ ID NO:371 or 372, or variants thereof that exhibit at least 65%, 70%, 75%, 80%, 85%, 90%, 91%, 92%, 93%, 94%, 95%, 96%, 97%, 98%, 99% or more sequence identity to any one of SEQ ID NOS: 371 or 372. The variants include variants that exhibit specific binding to HA. Variants include allelic variants, species variants or other variants containing an amino acid modification (e.g., to increase affinity or specificity to HA). Species variants of stabilin-1 provided for use in the methods herein include, but are not limited to, mouse (SEQ ID NO:255) and bovine (SEQ ID NO:256) and species variants of stabilin-2 provided for use in the methods herein include, but are not limited to, mouse (SEQ ID NO:257) and rat (SEQ ID NO:258).

Also provided herein for use in the methods herein is a Stabilin-1-LM or Stabilin-1-LM multimer that exhibits increased affinity for HA. For example, Stabilin-1-LM for use in the methods herein is one that is generated by expression of a nucleic acid molecule encoding the link module set forth in any one of SEQ ID NOS: 371 or 372 or a nucleic acid encoding a link module having a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 371 or 372 linked directly or indirectly to a nucleic acid encoding a multimerization domain, such as an Fc portion of an immunoglobulin. Hence, the resulting LM multimer contains a first polypeptide set forth in any one of SEQ ID NOS: 371 or 372 or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 371 or 372 linked directly or indirectly to a multimerization domain; and a second polypeptide set forth in any one of SEQ ID NOS: 371 or 372 or a sequence of amino acids that exhibits at least 65%, 70%, 75%, 80%, 84%, 90%, 91%, 92%, 93%, 94%, 95%, 96%, 97%, 98%, 99% or more sequence identity to a sequence set forth in any of SEQ ID NOS: 371 or 372 linked directly or indirectly to a multimerization domain.

b. Type B: CD44 Sub-Group

HABPs for use in the methods herein are HABPs that are members of the Type B sub-group having an HA-binding domain that contains a single link module with N- and C-terminal extensions that binds to hyaluronan. Unlike the HA binding domain of the Type A/TSG-6 sub-group, the flanking sequences of the link domain are essential for the structural integrity of the Type B domain and are required for binding to HA. Members of the Type B sub-group of HABPs for use in the methods provided herein include, but are not limited to, CD44 and LYVE-1, or HA binding fragments thereof.

i. CD44

A Type B sub-group HABP provided for use in the methods herein is CD44, HA binding domains of CD44 or portions thereof sufficient to bind to HA. CD44 is an 80- to 250-kDa Type I transmembrane glycoprotein that binds hyaluronan and a variety of extracellular and cell-surface ligands. CD44 has diverse functions and is involved in attachment, organization and turnovers of the extracellular matrix and mediates the migration of lymphocytes during inflammation. The ability of CD44 to interact with HA is regulated by factors, including receptor clustering and changes in glycosylation of the extracellular domain. CD exists in numerous isoforms due to alternative splicing of 10 variant exons, all of which contain the hyaluronan binding domain containing the link module. An exemplary CD44 full length sequence is set forth in SEQ ID NO:227. The hyaluronan binding domain of CD44 is approximately 160 amino acids in length (SEQ ID NO:341) and contains the link module flanked by N- and C-terminal extensions linked by a disulfide bond (Cys9 and Cys110 of the CD44 HA binding domain set forth in SEQ ID NO:341). Arg41 and Arg78 are critical for HA binding (corresponding to amino acids Arg22 and Arg59 of the CD44 HA binding domain set forth in SEQ ED NO:341) and Tyr42 and Tyr79 (corresponding to amino acids Tyr23 and Tyr60 of the CD44 HA binding domain set forth in SEQ ID NO:341) are essential for CD44 functional activity. The link domain of CD44 is set forth in SEQ ID NO:375. Thus provided herein for use in the methods herein are fragments of CD44 that retain the ability to bind to HA, for example, a fragment of CD44 that contains a link domain and N- and C-terminal flanking domains or a sufficient portion thereof to effect binding to HA.

Also provided herein for use in the provided methods are variants, including allelic variants, species variants and other variants containing an amino acid modification, as long as the variants retain their ability to bind to HA. Species variants of CD44 for use in the methods provided herein include, but are not limited to, mouse (SEQ ID NO:259), rat (SEQ ID NO:260), bovine (SEQ ID NO:261), dog (SEQ ID NO:262), horse (SEQ ID NO:263), hamster (SEQ ID NO:264), baboon (SEQ ID NO:265) and golden hamster (SEQ ID NO:266). Variants of CD44, or HA binding fragments thereof, for use in the provided methods include variants that have an amino acid modification and that exhibit an altered, such as improved, activity compared to a CD44 not containing the modification. Such variants include those that contain amino acid modifications that enhance the binding affinity of CD44 to HA, increase the specificity of CD44 for HA, and/or increase the solubility of CD44.

ii. LYVE-1

Provided herein for use in the methods provided herein is a Type B sub-group HABP that is LYVE-1, HA binding domains of LYVE-1 or portions thereof sufficient to bind to HA. Lymphatic Vessel Endothelial Hyaluronan (HA) Receptor-1 (LYVE-1, also called CRSBP-1, HAR, and XLKD1; SEQ ID NO:228) is a 60-kDa type I transmembrane glycoprotein that is expressed on both the lumenal and abluminal surfaces of lymphatic endothelium, and also on hepatic blood sinusoidal endothelia. LYVE-1 participates in HA internalization for degradation and transport of HA from tissues into the lumen of lymphatic vessels. LYVE-1-directed HA localization to lymphatic surfaces also affects aspects of the immune response or tumor metastases. The link module of LYVE-1 is located at amino acids 40-129 of SEQ ID NO:228 and is set forth in SEQ ID NO:376. Thus provided herein for use in the methods herein are fragments of LYVE-1 that retain the ability to bind to HA, for example, a fragment of LYVE-1 that contains a link domain and N- and C-terminal flanking domains or a sufficient portion thereof to effect binding to HA.

Also provided herein for use in the provided methods are variants, including allelic variants, species variants and other variants containing an amino acid modification, as long as the variants retain their ability to bind to HA. Species variants of LYVE-1 include, but are not limited to, mouse (SEQ ID NO:267) and bovine (SEQ ID NO:268). Variants of LYVE-1, or HA binding fragments thereof, for use in the provided methods include variants that have an amino acid modification and that exhibit an altered, such as improved, activity compared to a LYVE-1 not containing the modification. Such variants include those that contain amino acid modifications that enhance the binding affinity of LYVE-1 to HA, increase the specificity of LYVE-1 for HA, and/or increase the solubility of LYVE-1.

c. Type C: Link Protein sub-group

HABPs for use in the methods herein are HABPs that are members of the Type C sub-group having an HA binding domain that contains an immunoglobulin (Ig) domain, which mediates binding between link protein and other Type C HA binding proteins, and two link modules, both of which are required for binding to HA. The Ig domain and two link modules collectively make up the G1 domain of Type C HABPs. Members of the Type C sub-group of HABPs for use in the methods provided herein include, but are not limited to, HAPLN1/link protein, HAPLN2, HAPLN3, HAPLN4, aggrecan, versican, brevican, neurocan, and phosphacan, or HA binding fragments thereof.

i. HAPLN/Link Protein Family

The Hyaluronan and Proteoglycan Link Protein (HAPLN) family is made up of four secreted proteoglycans that bind hyaluronan and contain one Ig-type C2-set domain and two link domains.

1) HAPLN1

A Type C sub-group HABP for use in the methods is HAPLN1, HA binding domains of HAPLN1 or portions thereof sufficient to bind to HA. Hyaluronan and Proteoglycan Link Protein 1 (HAPLN1, also called as link protein and CRTL1; SEQ ID NO:229) contributes to extracellular matrix stability and flexibility by stabilizing interactions of HA with chondroitin sulfate proteoglycans. HAPLN1 contains two link modules (amino acids 159-253 and amino acids 260-350 of SEQ ID NO:229) that bind to HA and an Ig module (amino acids 53-160 of SEQ ID NO:229) that binds to the Ig module of the G1 domain of aggrecan. HAPLN1 stabilizes associations of HA with aggrecan by forming a ternary complex containing an HA linear backbone with perpendicularly attached aggrecan and HAPLN1. Aggrecan and HAPLN1 lie parallel to each other, while HA runs between the two HAPLN1 link modules and the two aggrecan link modules. The complex creates a gel-like substance with resistance to deformation. HAPLN1 also stabilizes the interaction of HA with other chondroitin sulfate proteoglycans, such as versican, neurocan, and brevican, which also have G1 domains containing an Ig module and two link modules, similar to aggrecan.

The G1 domain of HAPLN1 contains the Ig domain and the 2 link modules. The Ig domain of the G1 domain of HAPLN1 is located at amino acids 53-160 of SEQ ID NO:229. The link modules of the G1 domain of HAPLN1 are located at amino acids 159-253 and 259-350 of SEQ ID NO:229 and are set forth in SEQ ID NOS: 377 and 378. Thus, provided herein for use in the methods herein are fragments of HAPLN1 that retain the ability to bind to HA, for example, a fragment of HAPLN1 that contains the G1 domain or a sufficient portion thereof to effect binding to HA. For example, provided herein for use in the methods herein is an HA binding fragment of HAPLN1 that contains at least the two link modules.

Typically, for use as a diagnostic for the detection of HA, HAPLN1 is provided in combination with another HA binding protein that contains the HA-binding region, such as, for example, the G1 domain of another Type C HABP, such as aggrecan, versican, brevican, neurocan, or phosphacan.

Also provided herein for use in the provided methods are variants, including allelic variants, species variants and other variants containing an amino acid modification, as long as the variants retain their ability to bind to HA. Species variants of HAPLN1 include, but are not limited to, bovine (SEQ ID NO:269 and 273), mouse (SEQ ID NO:270), rat (SEQ ID NO:271), chicken (SEQ ID NO:272), horse (SEQ ID NO:274) and pig (SEQ ID NO:275). Variants of HAPLN1, or HA binding fragments thereof, for use in the provided methods include variants that have an amino acid modification and that exhibit an altered, such as improved, activity compared to an HAPLN1 not containing the modification. Such variants include those that contain amino acid modifications that enhance the binding affinity of HAPLN1 to HA, increase the specificity of HAPLN1 for HA, and/or increase the solubility of HAPLN1.

HABPs for use in the methods provided herein is a Type C sub-group HABP that is HAPLN2, HA binding domains of HAPLN2 or portions thereof sufficient to bind to HA. Hyaluronan and Proteoglycan Link Protein 2 (HAPLN2; SEQ ID NO:230), also known as brain link protein 1, is predominantly expressed in brain. The G1 domain of HAPLN2 contains the Ig domain and the 2 link modules. The Ig domain of the G1 domain of HAPLN2 is located at amino acids 49-149 of SEQ ID NO:230. The link modules of the G1 domain of HAPLN2 are located at amino acids 148-241 and 247-337 of SEQ ID NO:230 and are set forth in SEQ ID NOS: 379 and 380.

Thus, provided herein for use in the methods herein are fragments of HAPLN2 that retain the ability to bind to HA, for example, a fragment of HAPLN2 that contains the G1 domain or a sufficient portion thereof to effect binding to HA. For example, provided herein for use in the methods herein is an HA binding fragment of HAPLN2 that contains at least the two link modules. Typically, for use as a diagnostic for the detection of HA, HAPLN2 is provided in combination with another HA binding protein that contains the HA-binding region, such as, for example, the G1 domain of another Type C HABP, such as aggrecan, versican, brevican, neurocan, or phosphacan.

Also provided herein for use in the provided methods are variants, including allelic variants, species variants and other variants containing an amino acid modification, as long as the variants retain their ability to bind to HA. Species variants of HAPLN2 include, but are not limited to, mouse (SEQ ID NO:276), rat (SEQ ID NO:277) and bovine (SEQ ID NO:278). Variants of HAPLN2, or HA binding fragments thereof, for use in the provided methods include variants that have an amino acid modification and that exhibit an altered, such as improved, activity compared to an HAPLN2 not containing the modification. Such variants include those that contain amino acid modifications that enhance the binding affinity of HAPLN2 to HA, increase the specificity of HAPLN1 for HA, and/or increase the solubility of HAPLN2.

3) HAPLN3

A Type C sub-group HABP provided for use in the methods herein is HAPLN3, HA binding domains of HAPLN3 or portions thereof sufficient to bind to HA. Hyaluronan and Proteoglycan Link Protein 3, (HAPLN3; SEQ ID NO:231), functions in hyaluronic acid binding and cell adhesion. HAPLN3 is upregulated in breast cancer and may be related to cancer development and metastasis. The G1 domain of HAPLN3 contains the Ig domain and the 2 link modules. The Ig domain of the G1 domain of HAPLN3 is located at amino acids 62-167 of SEQ ID NO:231. The link modules of the G1 domain of HAPLN3 are located at amino acids 166-260 and 266-357 of SEQ ID NO:231 and are set forth in SEQ ID NOS: 381 and 382.

Thus, provided herein for use in the methods herein are fragments of HAPLN3 that retain the ability to bind to HA, for example, a fragment of HAPLN3 that contains the G1 domain or a sufficient portion thereof to effect binding to HA. For example, provided herein for use in the methods herein is an HA binding fragment of HAPLN3 that contains at least the two link modules. Typically, for use as a diagnostic for the detection of HA, HAPLN3 is provided in combination with another HA binding protein that contains the HA-binding region, such as, for example, the G1 domain of another Type C HABP, such as aggrecan, versican, brevican, neurocan, or phosphacan.

Also provided herein for use in the methods herein are variants, including allelic variants, species variants and other variants containing an amino acid modification, as long as the variants retain their ability to bind to HA. Species variants of HAPLN3 include, but are not limited to, mouse (SEQ ID NO:279), rat (SEQ ID NO:280) and bovine (SEQ ID NO:281). Variants of HAPLN3, or HA binding fragments thereof, for use in the provided methods include variants that have an amino acid modification and that exhibit an altered, such as improved, activity compared to an HAPLN3 not containing the modification. Such variants include those that contain amino acid modifications that enhance the binding affinity of HAPLN3 to HA, increase the specificity of HAPLN3 for HA, and/or increase the solubility of HAPLN3.

4) HAPLN4

Provided herein for use in the methods herein is a Type C sub-group HABP that is HAPLN4, HA binding domains of HAPLN4 or portions thereof sufficient to bind to HA. Hyaluronan and Proteoglycan Link Protein 4, (HAPLN4; SEQ ID NO:232), also known as brain link protein 2, is predominantly expressed in brain. HAPLN4 participates in the development of the perineuronal matrix. Human and mouse HAPLN4 share 91% amino acid sequence identity. The G1 domain of HAPLN4 contains the Ig domain and the 2 link modules. The Ig domain of the G1 domain of HAPLN4 is located at amino acids 60-164 of SEQ ID NO:232. The link modules of the G1 domain of HAPLN4 are located at amino acids 163-267 and 273-364 of SEQ ID NO:232 and are set forth in SEQ ID NOS: 383 and 384.

Thus, provided herein for use in the methods herein are fragments of HAPLN4 that retain the ability to bind to HA, for example, a fragment of HAPLN4 that contains the G1 domain or a sufficient portion thereof to effect binding to HA. For example, provided herein for use in the methods herein is an HA binding fragment of HAPLN4 that contains at least the two link modules. Typically, for use as a diagnostic for the detection of HA, HAPLN4 is provided in combination with another HA binding protein that contains the HA-binding region, such as, for example, the G1 domain of another Type C HABP, such as aggrecan, versican, brevican, neurocan, or phosphacan.

Also provided herein for use in the provided methods are variants of HAPLN4, including allelic variants, species variants and other variants containing an amino acid modification, as long as the variants retain their ability to bind to HA. Species variants of HAPLN4 include, but are not limited to, mouse (SEQ ID NO:282), bovine (SEQ ID NO:283) and rat (SEQ ID NO:284). Variants of HAPLN4, or HA binding fragments thereof, for use in the provided methods include variants that have an amino acid modification and that exhibit an altered, such as improved, activity compared to an HAPLN4 not containing the modification. Such variants include those that contain amino acid modifications that enhance the binding affinity of HAPLN4 to HA, increase the specificity of HAPLN4 for HA, and/or increase the solubility of HAPLN4.

5) Aggrecan

HABPs for use in the methods herein is a Type C sub-group HABP that is aggrecan, HA binding domains of aggrecan or portions thereof sufficient to bind to HA. Aggrecan (SEQ ID NO:233) belongs to the chondroitin sulfate (CS) proteoglycan family, which also includes versican, brevican, neurocan, and phosphacan. Each aggrecan molecule contains approximately 100 and 30 keratan sulfate and glycosaminoglycan (GAG) side chains, respectively. Aggrecan non-covalently associates with hyaluronan via the link modules and an Ig domain in its N-terminus. It is the most abundant proteoglycan in cartilage, and contributes to the load-bearing capacity of this tissue.

The G1 domain of aggrecan is located at amino acids 45-352 of SEQ ID NO:233. The Ig domain of the G1 domain of aggrecan is located at amino acids 45-154 of SEQ ID NO:233 and is set forth in SEQ ID NO:423. The link modules of the G1 domain of aggrecan are located at amino acids 153-247 and 254-349 of SEQ ID NO:233 and are set forth in SEQ ID NOS: 385 and 386. Link modules 3 and 4 are set forth in SEQ ID NOS: 387-388. Thus, provided herein for use in the methods herein are fragments of aggrecan that retain the ability to bind to HA, for example, a fragment of aggrecan that contains the G1 domain or a sufficient portion thereof to effect binding to HA. Exemplary of an aggrecan is a recombinant human aggrecan G1-IGD-G2 domains, Val20-Gly676 with a C-terminal 10-HIS tag (Accession No. NP_037359; set forth in SEQ ID NO:202, available at R&D Systems, Catalog No. 1220-PG).

Also provided herein for use in the provided methods are variants of aggrecan, including allelic variants, species variants and other variants containing an amino acid modification, as long as the variants retain their ability to bind to HA. Species variants of aggrecan include, but are not limited to, pig (SEQ ID NO:285), chicken (SEQ ID NO:286), mouse (SEQ ID NO:287), bovine (SEQ ID NO:288), dog (SEQ ID NO:289), rat (SEQ ID NO:290) and rabbit (SEQ ID NO:291). Variants of aggrecan, or HA binding fragments thereof, for use in the provided methods include variants that have an amino acid modification and that exhibit an altered, such as improved, activity compared to an aggrecan not containing the modification. Such variants include those that contain amino acid modifications that enhance the binding affinity of aggrecan to HA, increase the specificity of aggrecan for HA, and/or increase the solubility of aggrecan.

6) Brevican

HABPs for use in the methods herein is a Type C sub-group HABP that is brevican, HA binding domains of brevican or portions thereof sufficient to bind to HA. Brevican (SEQ ID NO:234) is a 160 kDa member of the aggrecan/versican proteoglycan family of matrix proteins. It is brain-derived and serves as a linker between hyaluronan and other matrix molecules such as the tenascins and fibulins. The G1 domain of brevican is located at amino acids 51-356 of SEQ ID NO:234 and is set forth in SEQ ID NO:424. The Ig domain of the G1 domain of brevican is located at amino acids 51-158 of SEQ ID NO:234. The link modules of the G1 domain of brevican are located at amino acids 157-251 and 258-353 of SEQ ID NO:234 and are set forth in SEQ ID NOS: 389 and 390. Thus, provided herein for use in the methods herein are fragments of brevican that retain the ability to bind to HA, for example, a fragment of brevican that contains the G1 domain or a sufficient portion thereof to effect binding to HA. For example, provided herein for use in the methods herein is an HA binding fragment of brevican that contains at least the two link modules.

Also provided herein for use in the provided methods are variants of brevican, including allelic variants, species variants and other variants containing an amino acid modification, as long as the variants retain their ability to bind to HA. Species variants of brevican include, but are not limited to, rat (SEQ ID NO:292), mouse (SEQ ID NO:293), bovine (SEQ ID NO:294) and cat (SEQ ID NO:295). Variants of brevican, or HA binding fragments thereof, for use in the provided methods include variants that have an amino acid modification and that exhibit an altered, such as improved, activity compared to a brevican not containing the modification. Such variants include those that contain amino acid modifications that enhance the binding affinity of brevican to HA, increase the specificity of brevican for HA, and/or increase the solubility of brevican.

7) Versican

HABPs for use in the methods herein is a Type C sub-group HABP that is versican, HA binding domains of versican or portions thereof sufficient to bind to HA. Versican (SEQ ID NO:235) is a large extracellular matrix proteoglycan that is present in a variety of tissues. It plays important structural roles, forming loose, hydrated matrices during development and disease. It also interacts directly or indirectly with cells to regulate such physiological processes as cell adhesion, survival, proliferation, and motility. The G1 domain of versican is located at amino acids 38-349 of SEQ ID NO:235 and is set forth in SEQ ID NO:425. The Ig domain of the G1 domain of versican is located at amino acids 38-151 of SEQ ID NO:235. The link modules of the G1 domain of versican are located at amino acids 150-244 and 251-346 of SEQ ID NO:235 and are set forth in SEQ ID NOS: 391 and 392. Thus, provided herein for use in the methods herein are fragments of versican that retain the ability to bind to HA, for example, a fragment of versican that contains the G1 domain or a sufficient portion thereof to effect binding to HA. For example, provided herein for use in the methods herein is an HA binding fragment of versican that contains at least the two link modules.

Also provided herein for use in the provided methods are variants of versican, including allelic variants, species variants and other variants containing an amino acid modification, as long as the variants retain their ability to bind to HA. Species variants of versican include, but are not limited to, mouse (SEQ ID NO:296), rat (SEQ ID NO:297), pig-tailed macaque (SEQ ID NO:298), bovine (SEQ ID NO:299) and chicken (SEQ ID NO:300). Variants of versican, or HA binding fragments thereof, for use in the provided methods include variants that have an amino acid modification and that exhibit an altered, such as improved, activity compared to a versican not containing the modification. Such variants include those that contain amino acid modifications that enhance the binding affinity of versican to HA, increase the specificity of versican for HA, and/or increase the solubility of versican.

8) Neurocan

HABPs for use in the methods herein is a Type C sub-group HABP that is neurocan, HA binding domains of neurocan or portions thereof sufficient to bind to HA. Neurocan, also known as CSPG3 and 1D1 (SEQ ID NO:236), is a secreted chondroitin sulfate proteoglycan that is primarily expressed in the central nervous system. Human Neurocan is predicted to be cleaved following Met635, resulting in N-terminal (Neurocan-130) and C-terminal (Neurocan-C) fragments. Neurocan and Neurocan-C are produced by astrocytes and accumulate in the matrix surrounding axonal bundles and neuronal cell bodies. Neurocan-130 is found mainly in the glial cell cytoplasm. Neurocan inhibits neuronal adhesion and neurite outgrowth through interactions with a variety of matrix and transmembrane molecules. The G1 domain of neurocan is located at amino acids 53-359 of SEQ ID NO:236 and is set forth in SEQ ID NO:426. The Ig domain of the G1 domain of neurocan is located at amino acids 53-161 of SEQ ID NO:236. The link modules of the G1 domain of neurocan are located at amino acids 160-254 and 261-356 of SEQ ID NO:236 and are set forth in SEQ ID NOS: 393 and 394. Thus, provided herein for use in the methods herein are fragments of neurocan that retain the ability to bind to HA, for example, a fragment of neurocan that contains the G1 domain or a sufficient portion thereof to effect binding to HA. For example, provided herein for use in the methods herein is an HA binding fragment of neurocan that contains at least the two link modules.

Also provided herein for use in the provided methods are variants, including allelic variants, species variants and other variants containing an amino acid modification, as long as the variants retain their ability to bind to HA. Species variants of neurocan include, but are not limited to, mouse (SEQ ID NO:301), rat (SEQ ID NO:302) and chimpanzee (SEQ ID NO:303). Variants of neurocan, or HA binding fragments thereof, for use in the provided methods include variants that have an amino acid modification and that exhibit an altered, such as improved, activity compared to a neurocan not containing the modification. Such variants include those that contain amino acid modifications that enhance the binding affinity of neurocan to HA, increase the specificity of neurocan for HA, and/or increase the solubility of neurocan.

9) Phosphacan

HABPs for use in the method provided herein is a Type C sub-group HABP that is phosphacan, HA binding domains of phosphacan or portions thereof sufficient to bind to HA. Phosphacan (SEQ ID NO:340) a chondroitin sulfate proteoglycan isolated from rat brain that binds to neurons and neural cell-adhesion molecules and may modulate cell interactions and other developmental processes in nervous tissue through heterophilic binding to cell-surface and extracellular matrix molecules, and by competition with ligands of the transmembrane phosphatase. Phosphacan has 76% identity to the extracellular portion of a human receptor-type protein tyrosine phosphatase (RPTP zeta/beta) and may represent an mRNA splicing variant of the larger transmembrane protein.

Also provided herein for use in the methods herein are variants, including allelic variants, species variants and other variants containing an amino acid modification, as long as the variants retain their ability to bind to HA. Species variants of phosphacan include, but are not limited to rat phosphacan (SEQ ID NO:237). Variants of phosphacan, or HA binding fragments thereof, for use in the provided methods include variants that have an amino acid modification and that exhibit an altered, such as improved, activity compared to a phosphacan not containing the modification. Such variants include those that contain amino acid modifications that enhance the binding affinity of phosphacan to HA, increase the specificity of phosphacan for HA, and/or increase the solubility of phosphacan.

2. HA Binding Proteins Without Link Modules

In some examples, provided herein for use in the methods herein are HA binding proteins that do not contain link modules. HA binding proteins without link modules for use in the methods provided herein include, but are not limited to, HABP1/C1QBP, layilin, RHAMM, IαI, CDC37, PHBP, SPACR, SPACRCAN, CD38, 1HABP4 and PEP-1, or HA binding fragments thereof.

a. HABP1/C1QBP

HABPs for use in the methods herein is a hyaluronan binding protein 1, HA binding domains of HABP1 or portions thereof sufficient to bind to HA. Hyaluronan binding protein 1 (HABP1; SEQ ID NO:240), also known as C1qBP/C1qR and p32, is a ubiquitous acidic glycoprotein that functions in spermatogenesis and as a receptor for proinflammatory molecules. HABP1 binds extracellular hyaluronan, vitronectin, complement component C1q, HMW kininogen, and bacterial and viral proteins. Intracellular HABP1 binds to molecules containing the C1q globular domain, multiple isoforms of PKC, mitochondrial Hrk, adrenergic and GABA-A receptors, the mRNA splicing factor ASF/SF2, and the CBF transcription factor.

Also provided herein for use in the methods herein are variants, including allelic variants, species variants and other variants containing an amino acid modification, as long as the variants retain their ability to bind to HA. Variants of HABP1, or HA binding fragments thereof, for use in the provided methods include variants that have an amino acid modification and that exhibit an altered, such as improved, activity compared to an HABP1 not containing the modification. Such variants include those that contain amino acid modifications that enhance the binding affinity of HABP1 to HA, increase the specificity of HABP1 for HA, and/or increase the solubility of HABP1.

b. Layilin

HABPs for use in the methods herein is a layilin, HA binding domains of layilin or portions thereof sufficient to bind to HA. Layilin (SEQ ID NOS: 238 and 239) is transmembrane protein with homology to C-type lectins and is named after the L-A-Y-1-L-I six amino acid motif in its transmembrane segment. Layilin binds specifically to hyaluronan and is found in the extracellular matrix of most animal tissues and in body fluids. It may modulate cell behavior and functions during tissue remodeling, development, homeostasis, and diseases.

Also provided herein for use in the methods herein are variants, including allelic variants, species variants and other variants containing an amino acid modification, as long as the variants retain their ability to bind to HA. Species variants of layilin include, but are not limited to, mouse (SEQ ID NO:304), hamster (SEQ ID NO:305) and rat (SEQ ID NO:306). Variants of layilin, or HA binding fragments thereof, for use in the provided methods include variants that have an amino acid modification and that exhibit an altered, such as improved, activity compared to a layilin not containing the modification. Such variants include those that contain amino acid modifications that enhance the binding affinity of layilin to HA, increase the specificity of layilin for HA, and/or increase the solubility of layilin.

c. RHAMM

HABPs for use in the methods herein is a RHAMM, HA binding domains of RHAMM or portions thereof sufficient to bind to HA. The receptor for HA-mediated motility (RHAMM; SEQ ID NO:242) is a membrane-associated protein, ranging in size from ~59 to 80 kDa. RHAMM is expressed on most cell types and functions to mediate adhesion and cell motility in response to HA binding. Also provided herein for use in the methods herein are variants, including allelic variants, species variants and other variants containing an amino acid modification, as long as the variants retain their ability to bind to HA. Species variants of RHAMM include, but are not limited to, mouse (SEQ ID NO:307) and rat (SEQ ID NO:308). Variants of RHAMM, or HA binding fragments thereof, for use in the provided methods include variants that have an amino acid modification and that exhibit an altered, such as improved, activity compared to a RHAMM not containing the modification. Such variants include those that contain amino acid modifications that enhance the binding affinity of RHAMM to HA, increase the specificity of RHAMM for HA, and/or increase the solubility of HABP1.

d. Others

Other HABPs that bind to HA some of which contain hyaluronan binding domains that can be used in the methods provided herein include, but are not limited to, IαI (SEQ ID NOS: 243-245), CDC37 (SEQ ID NO:250), PHBP (SEQ ID NO:251), SPACR (SEQ ID NO:246), SPACRCAN (SEQ ID NO:247), CD38 (SEQ ID NO:248), IHABP4 (SEQ ID NO:249) and PEP-1 (SEQ ID NO:241), or HA binding domains or portions thereof sufficient to bind to HA. Also provided herein for use in the methods herein are variants, including allelic variants, species variants and other variants containing an amino acid modification, as long as the variants retain their ability to bind to HA. Species variants include, but are not limited to, IαI from mouse (SEQ ID NOS: 309-311) and bovine (SEQ ID NOS: 312-314), CDC37 from Baker's yeast (SEQ ID NO:326), fruit fly (SEQ ID NO:327), rat (SEQ ID NO:328), mouse (SEQ ID NO:329), fission yeast (SEQ ID NO:330), fruit fly (SEQ ID NO:331), chicken (SEQ ID NO:332), bovine (SEQ ID NO:333), *Candida albicans* yeast (SEQ ID NO:334). *Caenorhabiditis elegans* (SEQ ID NO:335) and green pufferfish (SEQ ID NO:336), SPACR from chicken (SEQ ID NO:315) and mouse (SEQ ID NO:316), SPACRCAN from mouse (SEQ ID NO:317), rat (SEQ ID NO:318) and chicken (SEQ ID NO:319), CD38 from mouse (SEQ ID NO:320), rat (SEQ ID NO:321), rabbit (SEQ ID NO:322) and cynomolgus monkey (SEQ ID NO:323), IHABP4 from mouse (SEQ ID NO:324) and chicken (SEQ ID NO:325), and PHBP from mouse (SEQ ID NO:337), rat (SEQ ID NO:338) and bovine (SEQ ID NO:339). Variants of HABPs, or HA binding fragments thereof, for use in the provided methods include variants that have an amino acid modification and that exhibit an altered, such as improved, activity compared to an HABP not containing the modification. Such variants include those that contain amino acid modifications that enhance the binding affinity of an HABP to HA, increase the specificity of an HABP for HA, and/or increase the solubility of an HABP, such as an IαI, CDC37, PHBP, SPACR, SPACRCAN, CD38, IHABP4 and PEP-1, or HA binding fragments thereof.

3. Modifications of HA Binding Proteins

Modified HABPs are provided herein to improve one or more properties of HABPs for use in the methods provided herein. Such properties include modifications increase protein expression in mammalian expression systems, improve biophysical properties such as stability and solubility, improve protein purification and detection and/or increase affinity to HA via dimerization of the fusion protein.

a. Multimers of HABP

HABPs provided for use in the methods herein can be linked directly or indirectly to a multimerization domain. The presence of a multimerization domain can generate multimers of HABPs or HA binding domains thereof to increase HA binding sites on a molecule. This can result in increased affinity of the HABP for HA. For example, affinity of an HABP multimer can be increased 2-fold, 3-fold, 4-fold, 5-fold, 6-fold, 7-fold, 8-fold, 9-fold, 10-fold or more compared to an HABP polypeptide not containing a multimerization domain. Affinity of an HABP multimer for HA represented by the dissociation constant (Kd) is generally less than $1\times10^{-8}$ M to $1\times10^{-10}$ M, such as at most $2\times10^{-8}$ M, $3\times10^{-8}$ M, $4\times10^{-8}$ M, $5\times10^{-8}$ M, $6\times10^{-8}$ M, $7\times10^{-8}$ M, $8\times10^{-8}$ M, $9\times10^{-8}$ M, $1\times10^{-9}$ M, $2\times10^{-9}$ M, $3\times10^{-9}$ M, $4\times10^{-9}$ M, $5\times10^{-9}$ M, $6\times$M, $7\times10^{-9}$ M, $8\times10^{-9}$ M, $9\times$M or lower.

Provided herein are multimers that include an HA binding domain or sufficient portion thereof to bind HA of a first HABP and an HA binding domain or sufficient portion thereof to bind HA of a second HABP, where the first and second HA-binding domain are linked directly or indirectly via a linker to a multimerization domain. The first and second HA-binding domain can be from the same HABP or from a different HABP. For example, if the HA-binding domain is the same, then homodimers or homotrimers can be generated. If the HA binding domain is different, then heterodimers or heterotrimers can be generated. For example, HA binding domains, such as a link domain or module, of HABPs can be covalently-linked, non-covalently-linked or chemically linked to form multimers of two or more HA binding domains. The link modules can be linked to form dimers, trimers, or higher multimers. In some instances, multimers can be formed by dimerization of two or more HABP polypeptides that each contain an HA binding domain.

Any portion of an HABP including an HA binding domain can be used as a multimer partner. For example, any of the HABPs described above, or those set forth in any of SEQ ID NOS: 206-207, 222-340, 407-414 or any portion of an HABP, including an HA binding domain, for example, a link domain or module and variants thereof, including any HA binding domains set forth in any of SEQ ID NOS: 341 and 371-394 can be used to generate chimeric HABP polypeptides, wherein all or part of the HABP polypeptide is linked to a multimerization domain. Typically, at least one, but sometimes both, of the HABP portions is all or a portion of an HABP sufficient to bind HA linked to a multimerization domain. Examples of HABPs, or portions thereof, for use as multimerization partners are described herein above and are set forth in any of SEQ ID NOS: 206-207, 222-341, 371-394, 407-414, 416-418 or 423-426. In some examples, at least one of the multimer partners is all or part of the HABP including the HA binding domain. For example, exemplary of multimeric HABP polypeptides is a multimer formed between the HA binding domain (e.g., link domain or link module), or portion thereof, of aggrecan, versican, neurocan, brevican, phosphacan, HAPLN1, HAPLN2, HAPLN3, HAPLN4, stabilin-1, stabilin-2, CAB61358, KIAA0527 or TSG-6 protein. Additionally, a chimeric HABP polypeptide for use in the formation of an HABP multimer can include hybrid HABP polypeptides linked to a multimerization domain. Exemplary of a multimer provided herein is a multimer, such as a homodimer, generated by multimerization of the link module (LM) of TSG-6 or sufficient portion thereof that binds to HA.

Multimerization between two HABP polypeptides can be spontaneous, or can occur due to forced linkage of two or more polypeptides. In one example, multimers can be linked by disulfide bonds formed between cysteine residues on different HABP polypeptides or domain or sufficient portions thereof that bind to HA. In another example, multimers can include an HABP polypeptide or domain or sufficient portion thereof to bind to HA joined via covalent or non-covalent interactions to peptide moieties fused to the each polypeptide. Such peptides can be peptide linkers (e.g., spacers) or peptides that have the property of promoting multimerization. In an additional example, multimers can be formed between two polypeptides through chemical linkage, such as for example, by using heterobifunctional linkers.

i. Peptide Linkers

Peptide linkers can be used to produce HABP polypeptide multimers, such as for example a multimer where at least one multimerization partner contains an HA binding domain (e.g., a link domain or module). In one example, peptide linkers can be fused to the C-terminal end of a first polypeptide and the N-terminal end of a second polypeptide. This structure can be repeated multiple times such that at least one, preferably 2, 3, 4, or more polypeptides are linked to one another via peptide linkers at their respective termini. For example, a multimer polypeptide can have a sequence $Z_1$—X—$Z_2$, where $Z_1$ and $Z_2$ are each a sequence of all or part of an HABP including an HA binding domain and where X is a sequence of a peptide linker. In some instances, $Z_1$ and/or $Z_2$ is all of an HABP including an HA binding domain. In other instances, $Z_1$ and/or $Z_2$ is part of an HABP including an HA binding domain. $Z_1$ and $Z_2$ are the same or they are different. In another example, the polypeptide has a sequence of $Z_1$—X—$Z_2$(—X—Z)—, where "n" is any integer, i.e., generally 1 or 2.

Typically, the peptide linker is of a sufficient length to allow one or both HA binding domains to bind to a hyaluronan substrate or to permit interaction between the HA binding domains (e.g., interaction of two Ig modules of the G1 HA binding domains of Type C HABPs). Examples of peptide linkers include, but are not limited to: -Gly-Gly-, GGGGG (SEQ ID NO:342), GGGGS or (GGGGS)n (SEQ ID NO:343), SSSSG or (SSSSG)n (SEQ ID NO:344), GKSSGSGSESKS (SEQ ID NO:345), GGSTSGSGKSSEGKG (SEQ ID NO:346), GSTSGSGKSSSEGSGSTKG (SEQ ID NO:347), GSTSGSGKPGSGEGSTKG (SEQ ID NO:348), EGKSSGSGSESKEF (SEQ ID NO:349), or AlaAlaProAla or (AlaAlaProAla)n (SEQ ID NO:350), where n is 1 to 6, such as 1, 2, 3, or 4. Exemplary linkers include:

(1) Gly4Ser with NcoI ends (SEQ ID NO:351)

```
CCATGGGCGG CGGCGGCTCT GCCATGG
```

(2) (Gly4Ser)$_2$ with NcoI ends (SEQ ID NO:352)

```
CCATGGGCGG CGGCGGCTCT GGCGGCGGCG GCTCTGCCAT GG
```

(3) (Ser4Gly)$_4$ with NcoI ends (SEQ ID NO:353)

```
CCATGGCCTC GTCGTCGTCG GGCTCGTCGT CGTCGGGCTC
GTCGTCGTCG GGCTCGTCGT CGTCGGGCGC CATGG
```

(4) (Ser4Gly)$_2$ with NcoI ends (SEQ ID NO:354)

```
CCATGGCCTC GTCGTCGTCG GGCTCGTCGT CGTCGGGCGC CATGG
```

Linking moieties are described, for example, in Huston et al. (1988) *PNAS* 85:5879-5883, Whitlow et al. (1993) *Protein Engineering* 6:989-995, and Newton et al., (1996) *Biochemistry* 35:545-553. Other suitable peptide linkers include any of those described in U.S. Pat. No. 4,751,180 or 4,935,233, which are hereby incorporated by reference. A polynucleotide encoding a desired peptide linker can be inserted between, and in the same reading frame as a polynucleotide encoding all or part of an HABP including an HA binding domain, using any suitable conventional technique. In one example, a fusion polypeptide has from two to four HABP polypeptides, including one that is all or part of an HABP polypeptide including an HA binding domain, separated by peptide linkers.

ii. Heterobifunctional Linking Agents

Linkage of an HABP polypeptide to another HABP polypeptide to create a heteromultimeric fusion polypeptide can be direct or indirect. For example, linkage of two or more HABP polypeptides can be achieved by chemical linkage or facilitated by heterobifunctional linkers, such as any known in the art or provided herein.

Numerous heterobifunctional cross-linking reagents that are used to form covalent bonds between amino groups and thiol groups and to introduce thiol groups into proteins, are known to those of skill in the art (see, e.g., the PIERCE CATALOG, *ImmunoTechnology Catalog & Handbook*, 1992-1993, which describes the preparation of and use of such reagents and provides a commercial source for such reagents; see, also, e.g., Cumber et al. (1992) *Bioconjugate Chem.* 3:397-401; Thorpe et al. (1987) *Cancer Res.* 47:5924-5931; Gordon et al. (1987) *Proc. Natl. Acad Sci.* 84:308-312; Walden et al. (1986) *J. Mol. Cell Immunol.* 2:191-197; Carlsson et al. (1978) *Biochem. J.* 173: 723-737; Mahan et al. (1987) *Anal. Biochem.* 162:163-170; Wawrzynczak et al. (1992) *Br. J Cancer* 66:361-366; Fattom et al. (1992) *Infection & Immun.* 60:584-589). These reagents can be used to form covalent bonds between the N-terminal portion of an HABP polypeptide including an HA binding domain and C-terminus portion of another HABP polypeptide including an HA binding domain or between each of those portions and a linker. These reagents include, but are not limited to: N-succinimidyl-3-(2-pyridyldithio)propionate (SPDP; disulfide linker); sulfosuccinimidyl 6-[3-(2-pyridyldithio)propionamido]hexanoate (sulfo-LC-SPDP); succinimidyloxycarbonyl-α-methyl benzyl thiosulfate (SMBT, hindered disulfate linker); succinimidyl 6-[3-(2-pyridyldithio) propionamido] hexanoate (LC-SPDP); sulfosuccinimidyl 4-(N-maleimidomethyl)cyclohexane-1-carboxylate (sulfo-SMCC); succinimidyl 3-(2-pyridyldithio)butyrate (SPDB; hindered disulfide bond linker); sulfosuccinimidyl 2-(7-azido-4-methylcoumarin-3-acetamide)ethyl-1,3'-dithiopropionate (SAED); sulfo-succinimidyl 7-azido-4-methylcoumarin-3-acetate (SAMCA); sulfosuccinimidyl-6-[alpha-methyl-alpha-(2-pyridyldithio)toluamido]-hexanoate (sulfo-LC-SMPT); 1,4-di-[3'-(2'-pyridyldithio)propionamido]butane (DPDPB); 4-succinimidyloxycarbonyl-α-methyl-α-(2-pyridylthio)toluene (SMPT, hindered disulfate linker); sulfosuccinimidyl-6-[α-methyl-α-(2-pyrimiyldi-thio)toluamido] hexanoate (sulfo-LC-SMPT); m-maleimidobenzoyl-N-hydroxy-succinimide ester (MBS); m-maleimidobenzoyl-N-hydroxysulfo-succinimide ester (sulfo-MBS); N-succinimidyl(4-iodoacetyl)aminobenzoate (SIAB; thioether linker); sulfosuccinimidyl-(4-iodoacetyl)amino benzoate (sulfo-SIAB); succinimidyl-4-(p-maleimidophenyl)butyrate (SMPB); sulfosuccinimidyl 4-(p-maleimidophenyl)butyrate (sulfo-SMPB); azidobenzoyl hydrazide (ABH). These linkers, for example, can be used in combination with peptide linkers, such as those that increase flexibility or solubility or that provide for or eliminate steric hindrance. Any other linkers known to those of skill in the art for linking a polypeptide molecule to another molecule can be employed. General properties are such that the resulting molecule binds to HA. For in vivo diagnostic use of the HABP reagent, generally the linker must be biocompatible for administration to animals, including humans.

iii. Polypeptide Multimerization Domains

Interaction of two or more HABP polypeptides can be facilitated by their linkage, either directly or indirectly, to any moiety or other polypeptide that are themselves able to interact to form a stable structure. For example, separate encoded HABP polypeptide chains can be joined by multimerization, whereby multimerization of the polypeptides is mediated by a multimerization domain. Typically, the multimerization domain provides for the formation of a stable protein-protein interaction between a first HABP polypeptide and a second HABP polypeptide. HABP polypeptides include, for example, linkage (directly or indirectly) of a nucleic acid encoding an HA binding domain (e.g., a link domain or module) of an HABP with a nucleic acid encoding a multimerization domain. Typically, at least one multimerization partner is a nucleic acid encoding all of part of an HABP including an HA binding domain linked directly or indirectly to a multimerization domain, thus forming a chimeric molecule. Homo- or heteromultimeric polypeptides can be generated from co-expression of separate HABP polypeptides. The first and second HABP polypeptides can be the same or different.

Generally, a multimerization domain includes any capable of forming a stable protein-protein interaction. The multimerization domains can interact via an immunoglobulin sequence (e.g., Fc domain; see e.g., International PCT Pub. Nos. WO 93/10151 and WO 2005/063816; U.S. Patent Publication No. 2006/0024298; U.S. Pat. No. 5,457,035), leucine zipper (e.g., from nuclear transforming proteins fos and jun or the proto-oncogene c-myc or from General Control of Nitrogen (GCN4)), a hydrophobic region, a hydrophilic region, or a free thiol which forms an intermolecular disulfide bond between the chimeric molecules of a homo- or heteromultimer. In addition, a multimerization domain can include an amino acid sequence containing a protuberance complementary to an amino acid sequence containing a hole, such as is described, for example, in U.S. Pat. No. 5,731,168; International PCT Pub. Nos. WO 98/50431 and WO 2005/063816; Ridgway et al. (1996) *Protein Engineering,* 9:617-621. Such a multimerization region can be engineered such that steric interactions not only promote stable interaction, but further promote the formation of heterodimers over homodimers from a mixture of chimeric monomers. Generally, protuberances are constructed by replacing small amino acid side chains from the interface of the first polypeptide with larger side chains (e.g., tyrosine or tryptophan). Compensatory cavities of identical or similar size to the protuberances are optionally created on the interface of the second polypeptide by replacing large amino acid side chains with smaller ones (e.g., alanine or threonine). Exemplary multimerization domains are described below.

An HABP polypeptide, such as for example any provided herein, including any HA binding domain (e.g., a link domain or module) of an HABP, can be joined anywhere, but typically via its N- or C-terminus, to the N- or C-terminus of a multimerization domain to form a chimeric polypeptide The linkage can be direct or indirect via a linker. Also, the chimeric polypeptide can be a fusion protein or can be formed by chemical linkage, such as through covalent or non-covalent interactions. For example, when preparing a chimeric polypeptide containing a multimerization domain, nucleic acid encoding all or part of an HABP including an HA binding domain can be operably linked to nucleic acid encoding the multimerization domain sequence, directly or indirectly or optionally via a linker domain. Typically, the construct encodes a chimeric protein where the C-terminus of the HABP polypeptide is joined to the N-terminus of the multimerization domain. In some instances, a construct can encode a chimeric protein where the N-terminus of the HABP polypeptide is joined to the N- or C-terminus of the multimerization domain.

A polypeptide multimer contains two chimeric proteins created by linking, directly or indirectly, two of the same or different HABP polypeptides directly or indirectly to a multimerization domain. In some examples, where the multimerization domain is a polypeptide, a gene fusion encoding the HABP-multimerization domain chimeric polypeptide is inserted into an appropriate expression vector. The resulting HABP-multimerization domain chimeric proteins can be expressed in host cells transformed with the recombinant expression vector, and allowed to assemble into multimers, where the multimerization domains interact to form multivalent polypeptides. Chemical linkage of multimerization domains to HABP polypeptides can be effected using heterobifunctional linkers as discussed above.

The resulting chimeric polypeptides, and multimers formed therefrom, can be purified by any suitable method such as, for example, by affinity chromatography over Protein A or Protein G columns. Where two nucleic acid molecules encoding different HABP chimeric polypeptides are transformed into cells, formation of homo- and heterodimers will occur. Conditions for expression can be adjusted so that heterodimer formation is favored over homodimer formation.

1) Immunoglobulin Domain

Multimerization domains include those containing a free thiol moiety capable of reacting to form an intermolecular disulfide bond with a multimerization domain of an additional amino acid sequence. For example, a multimerization domain can include a portion of an immunoglobulin molecule, such as from IgG1, IgG2, IgG3, IgG4, IgA, IgD, IgM, and IgE. Generally, such a portion is an immunoglobulin constant region (Fc). Preparations of fusion proteins containing polypeptides fused to various portions of antibody-derived polypeptides (including the Fc domain) has been described, see e.g., Ashkenazi et al. (1991) *PNAS* 88: 10535; Byrn et al. (1990) *Nature,* 344:667; and Hollenbaugh and Aruffo, (2002) "Construction of Immunoglobulin Fusion Proteins," in *Current Protocols in Immunology*, Ch. 10, pp. 10.19.1-10.19.11.

Antibodies bind to specific antigens and contain two identical heavy chains and two identical light chains covalently linked by disulfide bonds. Both the heavy and light chains contain variable regions, which bind the antigen, and constant (C) regions. In each chain, one domain (V) has a variable amino acid sequence depending on the antibody specificity of the molecule. The other domain (C) has a rather constant sequence common among molecules of the same class. The domains are numbered in sequence from the amino-terminal end. For example, the IgG light chain is composed of two immunoglobulin domains linked from N- to C-terminus in the order $V_L$-$C_L$, referring to the light chain variable domain and the light chain constant domain, respectively. The IgG heavy chain is composed of four immunoglobulin domains linked from the N- to C-terminus in the order $V_H$-$C_H1$-$C_H2$-$C_H3$, referring to the variable heavy domain, contain heavy domain 1, constant heavy domain 2, and constant heavy domain 3. The resulting antibody molecule is a four chain molecule where each heavy chain is linked to a light chain by a disulfide bond, and the two heavy chains are linked to each other by disulfide bonds. Linkage of the heavy chains is mediated by a flexible region of the heavy chain, known as the hinge region. Fragments of antibody molecules can be generated, such as for example, by enzymatic cleavage. For example, upon protease cleavage by papain, a dimer of the heavy chain constant regions, the Fc domain, is cleaved from the two Fab regions (i.e., the portions containing the variable regions).

In humans, there are five antibody isotypes classified based on their heavy chains denoted as delta (δ), gamma (γ), mu (μ), and alpha (α) and epsilon (ε), giving rise to the IgD, IgG, IgM, IgA, and IgE classes of antibodies, respectively. The IgA and IgG classes contain the subclasses IgA1, IgA2, IgG1, IgG2, IgG3, and IgG4. Sequence differences between immunoglobulin heavy chains cause the various isotypes to differ in, for example, the number of C domains, the presence of a hinge region, and the number and location of interchain disulfide bonds. For example, IgM and IgE heavy chains contain an extra C domain (C4), that replaces the hinge region. The Fc regions of IgG, IgD, and IgA pair with each other through their Cγ3, Cδ3, and Cα3 domains, whereas the Fc regions of IgM and IgE dimerize through their $C_\mu 4$ and Cε4 domains. IgM and IgA form multimeric structures with ten and four antigen-binding sites, respectively.

HABP immunoglobulin chimeric polypeptides provided herein include a full-length immunoglobulin polypeptide. Alternatively, the immunoglobulin polypeptide is less than full length, i.e., containing a heavy chain, light chain, Fab, $Fab_2$, Fv, or Fc. In one example, the HABP immunoglobulin chimeric polypeptides are assembled as monomers or hetero- or homo-multimers, and particularly as dimers or tetramers. Chains or basic units of varying structures can be utilized to assemble the monomers and hetero- and homo-multimers. For example, an HABP polypeptide can be fused to all or part of an immunoglobulin molecule, including all or part of $C_H$, $C_L$, $V_H$, or $V_L$ domain of an immunoglobulin molecule (see. e.g., U.S. Pat. No. 5,116,964). Chimeric HABP polypeptides can be readily produced and secreted by mammalian cells transformed with the appropriate nucleic acid molecule. The secreted forms include those where the HABP polypeptide is present in heavy chain dimers; light chain monomers or dimers; and heavy and light chain heterotetramers where the HABP polypeptide is fused to one or more light or heavy chains, including heterotetramers where up to and including all four variable region analogues are substituted. In some examples, one or more than one nucleic acid fusion molecule can be transformed into host cells to produce a multimer where the HABP portions of the multimer are the same or different. In some examples, a non-HABP polypeptide light-heavy chain variable-like domain is present, thereby producing a heterobifunctional antibody. In some examples, a chimeric polypeptide can be made fused to part of an immunoglobulin molecule lacking hinge disulfides, in which non-covalent or covalent interactions of the two HABPs polypeptide portions associate the molecule into a homo- or heterodimer.

Fc Domain

Typically, the immunoglobulin portion of an HABP chimeric protein includes the heavy chain of an immunoglobulin polypeptide, most usually the constant domains of the heavy chain. Exemplary sequences of heavy chain constant regions for human IgG sub-types are set forth in SEQ ID NOS: 355 (IgG1), SEQ ID NO:356 (IgG2), SEQ ID NO:357 (IgG3), and SEQ ID NO:358 (IgG4). For example, for the exemplary heavy chain constant region set forth in SEQ ID NO:355, the $C_H1$ domain corresponds to amino acids 1-98, the hinge region corresponds to amino acids 99-110, the $C_H2$ domain corresponds to amino acids 111-223, and the $C_H3$ domain corresponds to amino acids 224-330.

In one example, an immunoglobulin polypeptide chimeric protein can include the Fc region of an immunoglobulin polypeptide. Typically, such a fusion retains at least a functionally active hinge, $C_H2$ and $C_H3$ domains of the constant region of an immunoglobulin heavy chain. For example, a full-length Fc sequence of IgG1 includes amino acids 99-330 of the sequence set forth in SEQ ID NO:355. An exemplary Fc sequence for hIgG1 is set forth in SEQ ID NO:359, and contains almost all of the hinge sequence corresponding to amino acids 100-110 of SEQ ID NO:355, and the complete sequence for the $C_H2$ and $C_H3$ domain as set forth in SEQ ID NO:355, with two amino acid replacements D239E and L241M. Another exemplary Fc polypeptide is the Fc polypeptide set forth in SEQ ID NO:204. Another exemplary Fc polypeptide is set forth in International PCT Publication No. WO 93/10151, and is a single chain polypeptide extending from the N-terminal hinge region to the native C-terminus of the Fc region of a human IgG1 antibody (SEQ ID NO:359). The precise site at which the linkage is made is not critical: particular sites are well known and can be selected in order to optimize the biological activity, secretion, or binding characteristics of the HABP polypeptide. For example, other exemplary Fc polypeptide sequences begin at amino acid C109 or P113 of the sequence set forth in SEQ ID NO:355 (see e.g., U.S. Patent Pub. No. 2006/0024298).

In addition to hIgG1 Fc, other Fc regions also can be included in the HABP chimeric polypeptides provided herein. For example, where effector functions mediated by Fc/FcγR interactions are to be minimized, fusion with IgG isotypes that poorly recruit complement or effector cells, such as for example, the Fc of IgG2 or IgG4, is contemplated. Additionally, the Fc fusions can contain immunoglobulin sequences that are substantially encoded by immunoglobulin genes belonging to any of the antibody classes, including, but not limited to IgG (including human subclasses IgG1, IgG2, IgG3, or IgG4), IgA (including human subclasses IgA1 and IgA2), IgD, IgE, and IgM classes of antibodies. Further, linkers can be used to covalently link Fc to another polypeptide to generate a Fc chimera.

Modified Fc domains also are contemplated herein for use in chimeras with HABP polypeptides. In some examples, the Fc region is modified such that it exhibits altered binding to an FcR so has to result altered (i.e., more or less) effector function than the effector function of an Fc region of a wild-type immunoglobulin heavy chain. Thus, a modified Fc domain can have altered affinity, including but not limited to, increased or low or no affinity for the Fc receptor. For example, the different IgG subclasses have different affinities for the FcγRs, with IgG1 and IgG3 typically binding substantially better to the receptors than IgG2 and IgG4. In addition, different FcγRs mediate different effector functions. FcγR1, FcγRIIa/c, and FcγRIIIa are positive regulators of immune complex triggered activation, characterized by having an intracellular domain that has an immunoreceptor tyrosine-based activation motif (ITAM). FcγRIIb, however, has an immunoreceptor tyrosine-based inhibition motif (ITIM) and is therefore inhibitory. In some instances, an HABP polypeptide Fc chimeric protein provided herein can be modified to enhance binding to the complement protein C1q. Further, an Fc can be modified to alter its binding to FcRn, thereby improving the pharmacokinetics of an HABP-Fc chimeric polypeptide. Thus, altering the affinity of an Fc region for a receptor can modulate the effector functions and/or pharmacokinetic properties associated with the Fc domain. Modified Fc domains are known to one of skill in the art and described in the literature, see e.g., U.S. Pat. No. 5,457,035; U.S. Patent Publication No. US 2006/0024298; and International PCT Publication No. WO 2005/063816 for exemplary modifications.

Typically, a polypeptide multimer is a dimer of two chimeric proteins created by linking, directly or indirectly, two of the same or different HABP polypeptides to an Fc polypeptide. In some examples, a gene fusion encoding the HABP-Fc chimeric protein is inserted into an appropriate expression vector. The resulting HABP-Fc chimeric proteins can be expressed in host cells transformed with the recombinant expression vector, and allowed to assemble much like antibody molecules, where interchain disulfide bonds form between the Fc moieties to yield divalent HABP polypeptides.

The resulting chimeric polypeptides containing Fc moieties, and multimers formed therefrom, can be easily purified by affinity chromatography over Protein A or Protein G columns. For the generation of heterodimers, additional steps for purification can be necessary. For example, where two nucleic acids encoding different HABP chimeric polypeptides are transformed into cells, the formation of heterodimers must be biochemically achieved since HABP chimeric molecules carrying the Fc-domain will be expressed as disulfide-linked homodimers as well. Thus, homodimers can be reduced under conditions that favor the disruption of interchain disulfides, but do no effect intra-chain disulfides. Typically, chimeric monomers with different HA-binding domain portions are mixed in equimolar amounts and oxidized to form a mixture of homo- and heterodimers. The components of this mixture are separated by chromatographic techniques. Alternatively, the formation of this type of heterodimer can be biased by genetically engineering and expressing HABP fusion molecules that contain an HABP polypeptide, followed by the Fc-domain of hIgG, followed by either c-jun or the c-fos leucine zippers (see below). Since the leucine zippers form predominantly heterodimers, they can be used to drive the formation of the heterodimers when desired.

HABP chimeric polypeptides containing Fc regions also can be engineered to include a tag with metal chelates or other epitope. The tagged domain can be used for rapid purification by metal-chelate chromatography, and/or by antibodies, to allow for detection of western blots, immunoprecipitation, or activity depletion/blocking in bioassays.

Exemplary HABP-Fc chimeric polypeptides include fusion protein of the TSG-6 link module (TSG-6-LM) and Fc. An exemplary TSG-6-LM-Fc is set forth in SEQ ID NO:212, and encoded by a sequence of nucleotides set forth in SEQ ID NO:211 or SEQ ID NO:217. In addition, HABP-Fc molecules, including for example the exemplary TSG-6-Fc molecules, can optionally contain an epitope tag or a signal for expression and secretion. For example, the exemplary TSG-6-LM-Fc chimeric polypeptide set forth as SEQ ID NO:212 contains human immunoglobulin light chain kappa (K) leader signal peptide sequence (amino acids 1-20, e.g. SEQ ID NO:210), an Fc fragment of the human IgG1 heavy chain (SEQ ID NO:204) and a human TSG-6 link module (SEQ ID NO:207). The cDNA sequence encoding the TSG-6-LM-Fc chimeric polypeptide is set forth in SEQ ID NO:211. The DNA encoding human IgG1 heavy chain and human TSG-6 link module regions are connected with a 6 bp AgeI restriction enzyme cleavage site and a 12 bp sequence, GACAAAACTCAC (SEQ ID NO:208), encoding four additional amino acids (DKTH; SEQ ID NO:209) 2) Leucine Zipper Another method of preparing HABP polypeptide multimers for use in the methods provided herein involves use of a leucine zipper domain. Leucine zippers are peptides that promote multimerization of the proteins in which they are found. Typically, leucine zipper is a term used to refer to a repetitive heptad motif containing four to five leucine residues present as a conserved domain in several proteins. Leucine zippers fold as short, parallel coiled coils, and are believed to be responsible for oligomerization of the proteins of which they form a' domain. The dimer formed by a leucine zipper domain is stabilized by the heptad repeat, designated (abcdefg)$_n$ (see e.g., McLachlan and Stewart (1978) *J. Mol. Biol.* 98:293), in which residues a and d are generally hydrophobic residues, with d being a leucine, which lines up on the same face of a helix. Oppositely-charged residues commonly occur at positions g and e. Thus, in a parallel coiled coil formed from two helical leucine zipper domains, the "knobs" formed by the hydrophobic side chains of the first helix are packed into the "holes" formed between the side chains of the second helix.

Exemplary leucine zippers for use as multimerization domains herein are derived from either of two nuclear transforming proteins, fos and jun, that exhibit leucine zipper domains, or the product of the murine proto-oncogene, c-myc. The leucine zipper domain is necessary for biological activity (DNA binding) in these proteins. The products of the nuclear oncogenes fos and jun contain leucine zipper domains that preferentially form a heterodimer (O'Shea et al. (1989) Science, 245:646; Turner and Tijian (1989) Science, 243: 1689). For example, the leucine zipper domains of the human transcription factors c-jun and c-fos have been shown to form stable heterodimers with a 1:1 stoichiometry (see e.g., Busch and Sassone-Corsi (1990) Trends Genetics, 6:36-40; Gentz et al., (1989) Science, 243:1695-1699). Although jun-jun homodimers also have been shown to form, they are about 1000-fold less stable than jun-fos heterodimers.

Thus, typically an HABP polypeptide multimer provided herein is generated using a jun-fos combination. Generally, the leucine zipper domain of either c-jun or c-fos is fused in frame at the C-terminus of an HABP of a polypeptide by genetically engineering fusion genes. Exemplary amino acid sequences of c-jun and c-fos leucine zippers are set forth in SEQ ID NOS: 362 and 363, respectively. In some instances, a sequence of a leucine zipper can be modified, such as by the addition of a cysteine residue to allow formation of disulfide bonds, or the addition of a tyrosine residue at the C-terminus to facilitate measurement of peptide concentration. Such exemplary sequences of encoded amino acids of a modified c-jun and c-fos leucine zipper are set forth in SEQ ID NOS: 362 and 363, respectively. In addition, the linkage of an HABP polypeptide with a leucine zipper can be direct or can employ a flexible linker domain, such as for example a hinge region of IgG, or other polypeptide linkers of small amino acids such as glycine, serine, threonine, or alanine at various lengths and combinations. In some instances, separation of a leucine zipper from the C-terminus of an encoded polypeptide can be effected by fusion with a sequence encoding a protease cleavage site, such as for example, a thrombin cleavage site. Additionally, the chimeric proteins can be tagged, such as for example, by a 6xHis tag, to allow rapid purification by metal chelate chromatography and/or by epitopes to which antibodies are available, such as for example a myc tag, to allow for detection on western blots, immunoprecipitation, or activity depletion/blocking bioassays.

Another exemplary leucine zipper domain for use as a multimerization domain is derived from a nuclear protein that functions as a transcriptional activator of a family of genes involved in the General Control of Nitrogen (GCN4) metabolism in S. cerevisiae. The protein is able to dimerize and bind promoter sequences containing the recognition sequence for GCN4, thereby activating transcription in times of nitrogen deprivation. An exemplary sequence of a GCN4 leucine zipper capable of forming a dimeric complex is set forth in SEQ ID NO:364. Amino acid substitutions in the a and d residues of a synthetic peptide representing the GCN4 leucine zipper domain (i.e., amino acid substitutions in the sequence set forth as SEQ ID NO:364) have been found to change the oligomerization properties of the leucine zipper domain. For example, when all residues at position a are changed to isoleucine, the leucine zipper still forms a parallel dimer. When, in addition to this change, all leucine residues at position d also are changed to isoleucine, the resultant peptide spontaneously forms a trimeric parallel coiled coil in solution. An exemplary sequence of such a GCN4 leucine zipper domain capable of forming a trimer is set forth in SEQ ID NO:365. Substituting all amino acids at position d with isoleucine and at position a with leucine results in a peptide that tetramerizes. Such an exemplary sequence of a leucine zipper domain of GCN4 capable of forming tetramers is set forth in SEQ ID NO:366. Peptides containing these substitutions are still referred to as leucine zipper domains since the mechanism of oligomer formation is believed to be the same as that for traditional leucine zipper domains such as the GCN4 described above and set forth in SEQ ID NO:364.

3) Protein-Protein Interaction Between Subunits

Exemplary of another type of multimerization domain for use in modifying an HABP provided for use in the methods herein is one where multimerization is facilitated by protein-protein interactions between different subunit polypeptides. Exemplary of such a multimerization domain is derived from the mechanism of cAMP-dependent protein kinase (PKA) with its anchoring domain (AD) of A kinase anchor proteins (AKAP). Thus, a heteromultimeric HABP polypeptide can be generated by linking (directly or indirectly) a nucleic acid encoding an HABP polypeptide, such as an HA-binding domain of an HABP polypeptide, with a nucleic acid encoding an R subunit sequence of PKA (i.e., SEQ ID NO:367). This results in a homodimeric molecule, due to the spontaneous formation of a dimer effected by the R subunit. In tandem, another HABP polypeptide fusion can be generated by linking a nucleic acid encoding another HABP polypeptide to a nucleic acid sequence encoding an AD sequence of AKAP (i.e., SEQ ID NO:368). Upon co-expression of the two components, such as following co-transfection of the HABP chimeric components in host cells, the dimeric R subunit provides a docking site for binding to the AD sequence, resulting in a heteromultimeric molecule. This binding event can be further stabilized by covalent linkages, such as for example, disulfide bonds. In some examples, a flexible linker residue can be fused between the nucleic acid encoding the HABP polypeptide and the multimerization domain. In another example, fusion of a nucleic acid encoding an HABP polypeptide can be to a nucleic acid encoding an R subunit containing a cysteine residue incorporated adjacent to the amino-terminal end of the R subunit to facilitate covalent linkage (see e.g., SEQ ID NO:369). Similarly, fusion of a nucleic acid encoding a partner HABP polypeptide can be to a nucleic acid encoding an AD subunit also containing incorporation of cysteine residues to both the amino- and carboxyl-terminal ends of AD (see e.g., SEQ ID NO:370).

4) Other Multimerization Domains

Other multimerization domains that can be used to multimerize an HABP provided for use in the methods herein are known to those of skill in the art and are any that facilitate the protein-protein interaction of two or more polypeptides that are separately generated and expressed as HABP fusions. Examples of other multimerization domains that can be used to provide protein-protein interactions between two chimeric polypeptides include, but are not limited to, the barnase-barstar module (see e.g., Deyev et al., (2003) Nat. Biotechnol. 21:1486-1492); use of particular protein domains (see e.g., Terskikh et al., (1997) Proc Natl Acad Sci USA 94: 1663-1668 and Muller et al., (1998) FEBS Lett. 422:259-264); use of particular peptide motifs (see e.g., de Kruif et al., (1996) J. Biol. Chem. 271:7630-7634 and Muller et al., (1998) FEBS Lett. 432: 45-49); and the use of disulfide bridges for enhanced stability (de Kruif et al., (1996) *J. Biol. Chem.* 271:7630-7634 and Schmiedl et al., (2000) *Protein Eng.* 13:725-734).

b. Mutations to Improve HA Binding

In a further example, provided herein for use in the methods herein are HABPs that are modified, such as by amino acid replacement, to exhibit increased specificity for hyaluronan compared to other GAGs. For example, provided herein is a mutant TSG-6-LM containing amino acid replacement(s) at amino acid residue 20, 34, 41, 54, 56, 72 and/or 84, and in particular at amino acid residue 20, 34, 41, and/or 54 (corresponding to amino acid residues set forth in SEQ ID NO:360). For example, with reference to the TSG-6-LM set forth in SEQ ID NO:207, the amino acid replacement or replacements is at amino acid residue 21, 35, 42, 55, 57, 73 or 85. The replacement amino acid can be to any other amino acid residue, and generally is to a non-basic amino acid residue. For example, amino acid replacement can be to Asp (D), Glu (E), Ser (S), Thr (T), Asn (N), Gln (O), Ala (A), Val (V), Ile (I), Leu (L), Met (M), Phe (F), Tyr (Y) or Trp (W). The amino acid replacement or replacements confer decreased binding to heparin. Binding can be reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more compared to binding of TSG-6-LM to heparin not containing the amino acid replacement. Exemplary of a TSG-6-LM mutant for use as a reagent in the method provided herein contains amino acid replacements corresponding to K20A/K34A/K41A. Hence, for example, binding to heparin is reduced such that specificity to hyaluronan is increased. The mutant TSG-6-LM can be conjugated directly or indirectly to a multimerization domain to generate multimers. For example, exemplary of a reagent for use in the methods herein is TSG-6-LM(K20A/K34A/K41A)-Fc (also called TSG-6-LM-Fc/ΔHep). The sequence of TSG-6-LM-Fc/ΔHep fragment is set forth in SEQ ID NO:214, which encodes the TSG-6-LM-Fc/ΔHep fusion protein set forth in SEQ ID NO:215.

c. Modifications of HA Binding Proteins for Detection

For use in the diagnostic methods provided herein, the HA binding proteins can be modified to contain a detectable protein or a moiety to facilitate detection.

i. Conjugation to Detectable Proteins or Moieties

The HA binding proteins for use in the diagnostic methods provided herein can be modified by conjugation to detectable moieties, including, but not limited to, peptides tags, radiolabels, fluorescent molecules, chemiluminescent molecules, bioluminescent molecules, Fc domains, biotin, enzymes that catalyze a detectable reaction or catalyze formation of a detectable product and proteins that bind a detectable compound. Detectable moieties, including proteins and compounds, or moieties that facilitate detection are known to one of skill in the art. The detectable moieties can be used to facilitate detection and/or purification of the HABP.

In one example, the HA binding protein is modified by conjugation to a detectable protein or to a protein that induces a detectable signal. The detectable protein or protein that induces a detectable signal can be selected from among a luciferase, a fluorescent protein, a bioluminescent protein, a receptor or transporter protein that binds to and/or transports a contrast agent, chromophore, compound or ligand that can be detected. For example, the detectable protein or protein that induces a detectable signal is a green fluorescent protein (GFP) or a red fluorescent protein (RFP).

Detectable labels can be used in any of the diagnostic methods provided herein. Exemplary detectable labels include, for example, chemiluminescent moieties, bioluminescent moieties, fluorescent moieties, radionuclides, and metals. Methods for detecting labels are well known in the art. Such a label can be detected, for example, by visual inspection, by fluorescence spectroscopy, by reflectance measurement, by flow cytometry, by X-rays, by a variety of magnetic resonance methods such as magnetic resonance imaging (MRI) and magnetic resonance spectroscopy (MRS). Methods of detection also include any of a variety of tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography, and ultrasonic tomography.

Exemplary of such proteins are enzymes that can catalyze a detectable reaction or catalyze formation of a detectable product, such as, for example, luciferases, such as a click beetle luciferase, a *Renilla* luciferase, a firefly luciferase or beta-glucuronidase (GusA). Also exemplary of such proteins are proteins that emit a detectable signal, including fluorescent proteins, such as a green fluorescent protein (GFP) or a red fluorescent protein (RFP). A variety of DNA sequences encoding proteins that can emit a detectable signal or that can catalyze a detectable reaction, such as luminescent or fluorescent proteins, are known and can be used in the methods provided herein. Exemplary genes encoding light-emitting proteins include, for example, genes from bacterial luciferase from *Vibrio harveyi* (Belas et al., (1982) *Science* 218:791-793), bacterial luciferase from *Vibrio fischeri* (Foran and Brown, (1988) *Nucleic acids Res.* 16:777), firefly luciferase (de Wet et al., (1987) *Mol. Cell. Biol.* 7:725-737), aequorin from *Aequorea victoria* (Prasher et al., (1987) *Biochem.* 26:1326-1332), *Renilla* luciferase from *Renilla reniformis* (Lorenz et al, (1991) *Proc Natl Acad Sci USA* 88:4438-4442) and green fluorescent protein from *Aequorea victoria* (Prasher et al., (1987) *Gene* 111:229-233). The luxA and luxB genes of bacterial luciferase can be fused to produce the fusion gene ($Fab_2$), which can be expressed to produce a fully functional luciferase protein (Escher et al., (1989) *PNAS* 86: 6528-6532).

Exemplary detectable proteins that can be conjugated to the HA binding proteins for use in the diagnostic methods provided herein also include proteins that can bind a contrasting agent, chromophore, or a compound or ligand that can be detected, such as a transferrin receptor or a ferritin; and reporter proteins, such as *E. coli* β-galactosidase, β-glucuronidase, xanthine-guanine phosphoribosyltransferase (gpt), and alkaline phosphatase. Also exemplary of detectable proteins are proteins that can specifically bind a detectable compound, including, but not limited to receptors, metal binding proteins (e.g., siderophores, ferritins, transferrin receptors), ligand binding proteins, and antibodies.

The HABP also can be conjugated to a protein or peptide tag. In one example, the HA binding protein is conjugated to an Fc domain. Protein and peptide tags also include, but are not limited to, HexaHis tag (SEQ ID NO:54), hemagglutinin (HA) tag (SEQ ID NO:420), FLAG tag (SEQ ID NO:55), c-myc tag (SEQ ID NO:419), VSV-G tag (SEQ ID NO:421), HSV tag (SEQ ID NO:422) and V5 tag (SEQ ID NO:415), chitin binding protein (CBP), maltose binding protein (MBP), and glutathione s-transferase (GST).

Detectable labels can be coupled or conjugated to an HABP through recombinant methods or by chemical methods. For example, conjugation can be effected by linking the protein, directly or indirectly to a linker such as a peptide linker or a chemical linker. Linkers can be polypeptide sequences, such as poly-Glycine sequences of between about 5 and 200 amino acids. Proline residues can be incorporated into a polypeptide linker to prevent the formation of significant secondary structural elements, i.e., $\alpha$-helix/$\beta$-sheet, by the linker. An example of a flexible linker is a polypeptide that includes a glycine chain with an intermediate proline. In other examples, a chemical linker is used to connect synthetically or recombinantly produced binding and labeling domain subsequences. Such flexible linkers are known to persons of skill in the art. For example, poly(ethylene glycol) linkers are available from Shearwater Polymers, Inc. Huntsville, Ala. These linkers optionally have amide linkages, sulfhydryl linkages, or heterofunctional linkages.

4. Selection of HA Binding Proteins for Diagnostic Use

An HA binding protein suitable for use as a diagnostic agent can be selected based on one or more desired properties or activities, including, but not limited to, specificity or affinity for HA, solubility, peptide stability, homogeneity, ease of expression and purification, minimum batch to batch variations in the expressed peptide, and low sample variability in HA binding and detection. In some examples, a single polypeptide diagnostic agent is contemplated over a diagnostic with multiple polypeptide components. For example, a link module that binds to HA in the absence of a complete link protein. The ability of an HABP provided herein to bind to hyaluronan can be assessed by methods well known in the art including, but not limited to ELISA-based assays, competitive binding assays with HA, heparin and other glycosaminoglycans, such as chondroitin sulfates A or C, heparan sulfates or dermatan sulfates.

E. HYPOXIA-ACTIVATED AGENTS AND TREATMENT WITH HYPOXIA-ACTIVATED AGENTS

The methods provided herein include using hypoxia-activated agents to treat hypoxia-related diseases and conditions, such as hyperproliferative diseases or conditions (e.g., tumors or cancers), in subjects selected as having a hypoxia-related disease or condition. The methods are based on the finding that the presence of aberrant or altered hyaluronan-associated markers (e.g., hyaluronan) in a subject (compared to normal or a predetermined level or amount) indicate that a subject has a hypoxia-related disease or condition. Hence, in the methods herein a subject is selected as having a hypoxia-related disease or condition based on an altered (e.g., elevated) level or amount of a hyaluronan-associated marker (e.g., hyaluronan) in sample, whereby the hypoxia-activated agents are administered to a subset of subjects that that are selected as hypoxic based on the level or amount of the hyaluronan-associated marker (e.g., hyaluronan).

Hypoxia-activated agents are drugs that are specifically active in a hypoxic microenvironment, including hypoxic zones of solid tumors. In particular examples provided herein, the hypoxia-activated agents are provided as formulations that target and/or penetrate the hypoxic regions of a tumor. The hypoxia-activated agents can be used singly or in combination with other cancer drugs or treatment, such as a hyaluronan-degrading enzyme (e.g., PEGPH20), anti-cancer antibody such as tumor-targeted antibodies, conventional chemotherapy agents or treatments such as chemotherapy or radiation.

Hypoxia-activated agents include agents that target various processes of hypoxic response, such as HIF-1 function, DNA repair and genomic instability. Hypoxia-activated agents also include hypoxia-activated prodrugs (HAPs) that selectively target hypoxic tumor cells because they are only converted to an active drug in the hypoxic environment of tumor tissue. HAPs contain bioreductive groups, such as quinones, N-oxides and aromatic nitro groups, that are reducible by endogenous reductase enzymes (e.g., P450 reductase and cytochrome P450s) that effect one-electron or two-electron reduction of the prodrug thereby forming cytotoxic radicals. HAPs include molecules where the bioreductive group itself can exhibit cytotoxicity in its reduced form. HAPs also include prodrugs containing an active agent (e.g., an antineoplastic agent) that is protected or masked by a bioreductive group (e.g., nitroheterocyclic group) whereby reduction of a bioreductive group triggers activation or release of the active agent, such as the neoplastic or other anti-cancer agent that exhibits cytotoxic activity.

In normal cells containing endogenous reductase enzymes, the prodrug radical or reduction intermediate that is formed is reoxidized back to the inactive prodrug. The oxidized prodrug form of the agent is relatively non-toxic. In tumor cells that have a low oxygen content, the oxidation back to the inactive prodrug is slower such that the prodrug radical form or intermediates build up or accumulates in the cell. In tumor cells, the formed prodrug radical or intermediates can then further react with and attack cellular components, such as the DNA, to result in cytotoxicity. Because these compounds are much less cytotoxic in the presence of oxygen, which can back-oxidize the cytotoxic reaction intermediate, they can specifically target and kill hypoxic tumor cells without affecting normal cells. For example, a number of enzymes can reduce the bioreductive group. In particular, cytochrome P450 reductase enzymes can reduce nitro or a quinone moiety in a bioreductive group in a first step respectively to a $NO_2(-)$ or a semiquinone radical anion. The hypoxic tumor zone can have a higher concentration of the reductase enzyme compared to normoxic tissue. Under normoxia, as in well vascularized healthy tissue, in the presence of oxygen, the $NO_2(-)$ or the semiquinone radical anion formed can react with oxygen to revert back to the bioreductive group and not ultimately generate or release a cytotoxic agent.

HAPs are well known in the art. Exemplary HAPs are described below. HAPs include prodrugs that are preferentially activated in hypoxic tumors. Such hypoxia-activated prodrugs include, but are not limited to, tirapazamine; nitroaromatic compounds (e.g., misonidazole; 1-methyl-3-(2-nitro-1-imidazolyl)-2-propanol and RB 6145; 2-nitroimidazole) (Adams et al. (1994) *Int. J. Radiat. Oncol. Biol. Phys.,* 29: 231-238); anthraquinones (e.g., AQ4N; 1,4-Bis-[[2-(dimethylamino-N-oxide)ethyl]amino]5,8-dihydroxyanthracene-9,10-dione) (Patterson, L. H., *Cancer Metastasis Rev.* (1993) 12: 119-134; Patterson, L. H. (2002) *Drug Metab. Rev.,* 34: 581-592; Patterson, L. H. et al. (2000) *Br. J Cancer* 82: 1984-1990); the chloroquinoline DNA-targeting unit to 2-nitroimidazole (e.g., NLCQ-1; 4-[3-(2-Nitro-1-imidazolyl)-propylamino]-7-chloroquinoline hydrochloride) (Papadopoulou, M. V. et al. *Clin. Cancer Res.* (2003) 9: 5714-5720); dinitrobenzamide mustards (e.g., SN23862; 5-(N,N-bis(2-chloroethyl)amino)-2,4-dinitrobenzamide and SN28343) (Siim, B. G., et al. (1997) *Oncol. Res.* 9:357-369; Helsby, N. A. et al. (2003) *Chem. Res. Toxicol.* 16: 469-478); nitrobenzyl phosphoramidate mustards (Nitroheterocyclic Phosphoramidates) (Borch, R. F. et al. (2000) *J. Med. Chem.* 43: 2258-2265); nitroheterocyclic methylquaternary salts (Nitroarylmethyl Quaternary Salts) (Tercel, M. et al. (2001) *J. Med. Chem.* 44: 3511-3522); cobalt(III) complexes (Wilson, W. R., et al. (1994) *Int. J. Radiat. Oncol. Biol. Phys.* 29:

323-327); indoloquinones (Everett, S. A., et al. (2002) *Biochem. Pharmacol.* 63: 1629-1639) and others known in the art. For example, an HAP can be, but is not limited to, a tirapazamine; CEN-209 (e.g., U.S. Pat. No. 7,816,521); banoxantrone (AQ4N; e.g., U.S. Pat. No. 5,132,327); porfiromycin (e.g., U.S. Pat. No. 3,226,393); apaziquone (EO9; e.g., U.S. Pat. No. 6,878,714); RH1 (e.g., U.S. Pat. No. 6,156,744); SN23862 (Palmer et al. (1992) J. Med. Chem., 21:3214-22); PR-104 (e.g., International PCT Publication No. WO2005/042471); SN-29730 (e.g., U.S. Pat. No. 7,718,688); KS119W (e.g., U.S. Pat. No. 7,405,317); NLCQ-1 (e.g., Papadopoulou et al. (2000) Oncol. Res., 12:185-192); SN24771 (e.g., U.S. Pat. No. 5,348,977); TH-302 (e.g., WO2007/002931); TH-1332 and TH-1431 (e.g., International PCT Publication No. WO2010/148138); PR-509 and PR-610 (e.g., ProActa, San Diego); and RB6145 (1-(2-nitro-1-imidazolyl)-3-(2-bromoethylamino)-2-propanol hydrobromide; EPA0319329 and Skarsgard et al. (1995) *Br. J. Cancer,* 72:1479-1486). Such HAPs include derivative, analogs, enantiomers, stereoisomers and tautomers of a prodrug, as well as pharmaceutically acceptable salts or solvates and metabolites from all stages. Exemplary non-limiting HAPs are described below.

1. Bioreductive Anticancer Agents

HAPs include compounds in which the prodrug radical is itself cytotoxic to cells. In such examples, the reductive event leads to the generation of reduced derivatives of a chemical group that itself is cytotoxic. Exemplary of such molecules include, but are not limited to, quinones such as mitomycin C (MMC), porfiromycin (PM), and EO9, N-oxides such as tirapazamine (TPZ), and a tertiary amine-N-oxide analogue of mitoxantrone (AQ4N).

a. Aromatic N-oxides i. Tirapazamine

Hypoxia-active agents include tirapazamine. Tirapazamine (TPZ, SR4233, 3-amino-1,2,4-benzotriazine-1,4-dioxide) is a prototypic HAP in the 1,2,4-benzotriazine oxide family of aromatic-N-oxides. The structure of tirapazamine is set forth below.

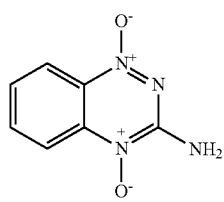

TPZ is reduced inside hypoxic cells by the NADPH-cytochrome P450 reductase (CYPOR), to form the TPZ radical. The TPZ radical is further decayed to form a hydroxy radical and a benzotriazinyl radical that causes complex DNA damages, including single strand breaks, double strand breaks, DNA-protein crosslinks, and base damages, and interferes with DNA topoisomerases, eventually leading to cell death. Homologous recombination is required to repair these damages, and cells defective in the homologous recombination pathway are more sensitive to TPZ (Evans et al., *Cancer Res.* (2008) 68:257-265). Under normoxia, the TPZ radical is back-oxidized to the non-toxic parent compound, by a process which also produces a superoxide radical, which is much less toxic than the TPZ radical (Brown, *Cancer Res.* (1999) 59:5863-5870). TPZ is 50-200-fold more toxic to hypoxic than to normoxic cells in culture (Brown, *British J Cancer* (1993) 67(6):1163-1170). TPZ enhances the anti-tumor activity of conventional chemotherapeutic agents such as cisplatin, without much additional toxicity, and can sensitize quiescent cells to chemotherapy. TPZ can also sensitize cells to radiation, by a distinct mechanism, when administered prior to radiation therapy (Marcu et al., *Current Clinical Pharmacology* (2006) 1:71-79).

TPZ is well known and is described in U.S. Pat. Nos. 3,957,779, 5,175,287, 5,672,702, 6,063,780, 6,121,263, 6,277,835, and 6,319,923, European Patent No. 0866709 WO 97/20828 and WO 98/39009.

ii. CEN-209

Hypoxia-active agents include CEN-209. CEN-209 (SN30000, 343-morpholinopropyl)-7,8-dihydro-6H-indeno[5,6-e][1,2,4]triazine-1,4-dioxide, described in U.S. Pat. Nos. 7,816,521, 7,989,451, U.S. Patent Publication Nos. 20090186886 and US20080234276) is a tirapazamine analog, The structure of CEN-209 is set forth below.

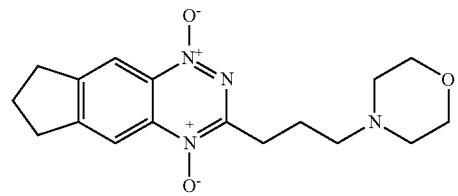

CEN-209 uses a similar mechanism of action as TPZ, causing complex DNA damage, replication fork arrest and cell death (Hicks et al., Clin. Cancer Res. (2010) 16:4946-4957). DNA repair after CEN-209-caused damage occurs through homologous recombination, and adding soluble NADPH-cytochrome P450 reductase (CYPOR) to a culture with CEN-209 increases cytotoxicity (Hunter et al. *Biochemical Pharmacology* (2012) 83:574-585). Compared to TPZ, CEN-209 has improved tissue penetration and higher hypoxic selectivity (Hicks et al., *Clin. Cancer Res.* (2010) 16:4946-4957).

b. Quinone i. Mitomycin C (MMC)

Hypoxia-active agents include mitomycin C. Mitomycin C (MMC, 6-Amino-8a-methoxy-5-methyl-4,7-dioxo-1,1a,2,4,7,8,8a,8b-octahydroazireno[2',1':3,4]pyrrolo[1,2-a]indol-8-yl]methyl carbamate), a prototypic HAP, is a naturally occurring quinone isolated from *Streptomyces caespitosus*. The structure of MMC is set forth below.

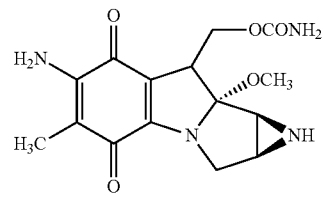

Inside the cell, the indoloquinone moiety of MMC is reduced, and results in monoalkylation of DNA or DNA intra- and inter-strand crosslinks (Fracasso et al., *Cancer Res* (1986) 46:3939-3944). MMC can be activated by two distinct mechanisms of reduction. The one-electron reduction of MMC, by several reductases including the NADPH-cytochrome c P450 reductase (CYPOR) and the xanthine oxidase, results in the formation of a semiquinone. Under hypoxia, the aziridine ring is activated, resulting in a covalent attachment of MMC to DNA. Following this attachment, MMC can be further reduced to form a second site for alkylation, and this reduction can be reversed by oxygen. (Ahn et al., *Frontiers in Bioscience* (2007) 12:3483-3501). Cells that overexpress CYPOR are more sensitive to PM and MMC (Belcourt et al., Proc. Natl. Acad. Sci. (1996) 456-460). The two-electron reduction, carried out by the diphtheria toxin diaphorase (DT-diaphorase, also known as NAD(P)H:quinone oxidoreductase (NOQ)), converts MMC into its hydroquinone form, a potent DNA alkylating agent. This reduction mechanism is not sensitive to oxygen (Ahn et al., *Frontiers in Bioscience* (2007) 12:3483-3501). The hypoxic cytotoxicity ratio of MMC is about 1 to 5. DT-diaphorase level is elevated in certain tumors, making the tumor more sensitive to MMC (Malkinson et al. *Cancer Res.* (1992) 52:4752-4757).

MMC is well known and the isolation and purification of MMC is described in U.S. Pat. Nos. 3,320,132, 3,660,578 and 5,180,670.

ii. Porfiromycin (PM)

Hypoxia-active agents include porfiromycin. Porfiromycin (PM, 6-Amino-1,1a,2,8,8a,8b-hexahydro-8-(hydroxymethyl)-8a-methoxy-1,5-dimethylazirino(2',1':3,4)pyrrolo[1,2-a]indole-4,7-dione carbamate) is a mitomycin C analog obtained from modifying MMC or from *Streptomyces ardus* cultures. The structure of porfiromycin is set forth below.

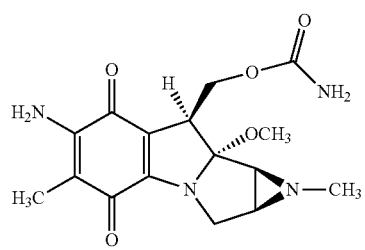

Similar to MMC, porfiromycin is activated by one-electron reductases, such as CYPOR and xanthine oxidase, and by two-electron reductases such as DT-diaphorase. Compared to MMC, PM has lower aerobic cytotoxicity, and higher hypoxic cytotoxicity (Keyes et al., *Cancer Res.* (1985)'45: 3642-3645). Activated PM leads to DNA alkylation, inter-strand crosslinking and cell death (Fracasso et al., *Cancer Res.* (1986) 3939-3944).

PM is well known and is described in U.S. Pat. Nos. 3,226, 393, 3,272,696, 3,306,821, 3,332,944, and British Patent No. GB 975771.

iii. EO9 (Apaziquone)

Hypoxia-active agents include EO9. EO9 (Apaziquone, EOquin, (E)-5-(1-Azirinyl)-3-(hydroxymethyl)-2-(3-hydroxy-1-propenyl)-1-methyl-1H-indole-4,7-dione, Spectrum Pharmaceuticals and Allergan Inc.) is an indolequinone hypoxia-activated analog of MMC. The structure of EO9 is set forth below.

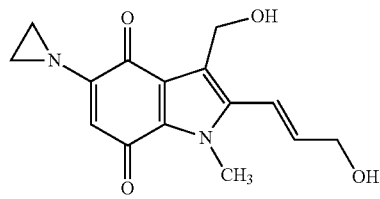 [SMILES: Cn1c(/C=C/CO)c(CO)c2c1C(=O)C=C(N1CC1)C2=O]

Similar to MMC and PM, EO9 can be reduced by one-electron and two-electron reductases, targeting both hypoxic solid tumors, which express high levels of CYPOR, and well-oxygenated malignant cells that overexpress DT-diaphorase (Loadman et al., *British Journal of Pharmacology* (2002) 137:701-709). In normoxic conditions, DT-diaphorase activity makes cells more chemosensitive to EO9, but in hypoxic conditions DT-diaphorase activity is inversely correlated with chemosensitivity to EO9 (Plumb et al., Br. J. Cancer (1994) 70:1136-1143). EO9 activated by intracellular reductases causes DNA alkylation and inter-strand crosslinking, leading to apoptotic cell death. EO9 can be administered using various delivery methods, such as direct intravenous injections and intravesical administration into the bladder (Hendricksen et al., *J. Urol.* 180: 116-120, International PCT Publication No. WO2008112934, U.S. Pat. No. 6,894,071). The EO9 compound and methods of administration are described in U.S. Pat. Nos. 6,878,714, 6,894,071, U.S. Patent Publication Nos. 200600223876, 20070054916, 20110288472, International PCT Publication Nos. WO1987006227, WO1997023456, WO2005021533, WO2006105507, WO2007092963, WO2007092964, WO2008112934, and British Patent No. GB 1087325).

iv. RH1

Hypoxia-active agents include RH1. RH1 (2,5-di(aziridin-1-yl)-3-(hydroxymethyl)-6-methylcyclohexa-2,5-diene-1,4-dione, described in U.S. Pat. No. 6,156,744, U.S. Patent Publication No. 20110288472 and International PCT Publication No. WO2007092964) is a water-soluble analog of the aziridinylbenzoquinone MeDZQ (Winski et al., *Clinical Cancer Res.* (1998) 4:3083-3088). The structure of RH1 is set forth below.

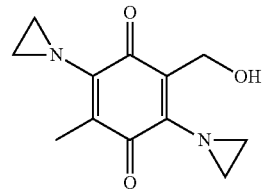 [SMILES: CC1=C(N2CC2)C(=O)C(CO)=C(N2CC2)C1=O]

Compared to other quinone-based HAPs, RH1 is a more efficient substrate for the two-electron reductase, DT-diaphorase (Winski et al., *Clinical Cancer Res.* (1998) 4:3083-3088), and can be an effective antitumor agent for treatment of cancer cells that have elevated DT-diaphorase activity. RH1 is a poor substrate for the NADPH-cytochrome c P450 reductase (CYPOR), and activation of RH1 in hypoxia occurs mainly through two-electron reduction (Begleiter et al., *Cancer Chemotherapy and Pharmacology* (2007) 60: 713-723).

Upon reduction, RH1 forms DNA inter-stand crosslink adducts and alkylates DNA through the activated aziridine group. This leads to DNA strand breaks and cytotoxicity. As the two-electron reduction by DT-diaphorase is less sensitive to oxygen levels, the reduced form of RH1 is more stable, and is less likely to generate toxic reactive oxygen species. In primary tumor cultures, RH1 induces efficient DNA crosslinking at relatively low doses (Ward et al., *Clin Cancer Res* (2005) 11:2695-2701).

v. Cyclopropamitosenes

Hypoxia-active agents include cylclopropamitosenes. Cyclopropamitosenes are indolequinone analogs of mitomycin C, based on the cyclopropamitosene ring system (Moody et al., *Anticancer Drugs* (1994) 5:367-372). The general structure of cyclopropamitosenes are set forth below.

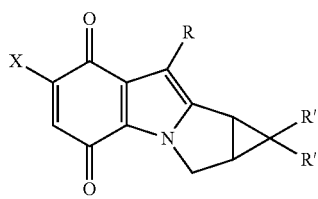

c. Tertiary amine N-oxides
i. AQ4N

Hypoxia-active agents include AQ4N and related compounds. AQ4N (Banoxantrone, 1,4-bis-{[2-(dimethylamino-Noxide)ethyl]amino}5,8-dihydroxyanthracene-9,10-dione, Novacea) is a di-N-oxide analogue of mitoxantrone, a DNA topoisomerase II inhibitor commonly used to treat cancer. The structure of AQ4N is set forth below.

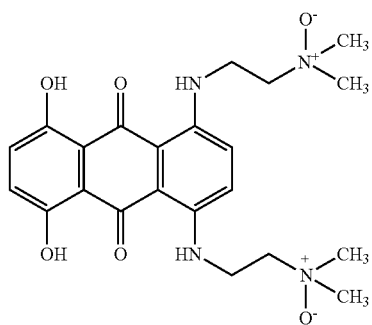

In normoxic conditions, AQ4N does not have DNA binding affinity due to the partial charge on the N-oxide and high aqueous solubility. In hypoxic conditions, it is reduced to form a mono-N-oxide intermediate (AQ4 M), and is reduced further to eventually form the activated alkylaminoanthraquinone AQ4. AQ4N is reduced in the cell through two-electron reduction by certain isoforms of cytochrome P450 (CYP), such as CYP1A, 2B6, 2E, 2S1, 2W1 and 3A (Raleigh et al., Int J Radiat Oncol Biol Phys (1998) 42:763-767, Raleigh et al., *Xenobiotica* (1999) 29:1115-1122, Nishida et al., Mol. Pharmacol. (2010) 78:497-502). Because AQ4N is not reduced by CYPOR, it does not form reactive oxygen species or undergo the redox cycling making the active AQ4 form more stable in the presence of oxygen (Patterson et al., *British Journal of Cancer* (2000) 83:1589-1593).

AQ4 is much more hydrophobic, and has a high affinity for DNA. AQ4 intercalates with high affinity to DNA and inhibits DNA topoisomerase II. AQ4 is stable at low pH and available to permeate to proximate tumor cells, and can provide bystander killing of surrounding tumor cells with normal oxygen levels (Patterson et al., *British Journal of Cancer* (2000) 83:1589-1593). The hypoxia specific cytotoxicity of AQ4 can be up to 1000-fold, in the presence of rat liver microsome (Patterson, *Cancer Metastasis Rev* (1993) 12:119-134) AQ4N is an effective enhancer of radiotherapy, as well as conventional chemotherapy using cisplatin or cyclophosphamide (Patterson et al., *British Journal of Cancer* (2000) 83:1589-1593). Cytochrome P450 isotypes CYP2S1 and CYP2W1, efficient activators of AQ4N, are overexpressed in many tumor cells (Karlgren et al., *Biochem Biophys Res Commun* (2006) 341:451-458). AQ4 penetrates hypoxic tumor cells effectively, and is found at higher concentrations in cells that express hypoxia-specific markers such as the glucose transporter-1 (Glut-1) (Albertella et al., *Clin Cancer Res* (2008) 14:1096-1104).

The synthesis of AQ4 and related compounds is described in U.S. Pat. Nos. 5,132,327, 5,447,950, 5,461,078, 6,320,063, 7,074,853, 7,276,537, U.S. Patent Publication Nos. 20050256188, 20060205820, 20070027136, 20070117784, 20070161808, International PCT Publication Nos. 1991005824, 2000005914, 2005080314, and 2008033440.

d. Nitro

Hypoxia-active agents include nitroaromatic and nitroheterocyclic compounds that readily can undergo reduction to form toxic metabolites, including the nitro radical anion (1e⁻ addition), the nitroso (2e⁻) and the hydroxylamine (4e⁻) products. In normal cells, these molecules react rapidly with oxygen to regenerate the parental molecule. In the absence of oxygen, however, they are reduced further to cytotoxic forms.

i. CB1954 and Analogs

Hypoxia-active agents include CB1954 and related compounds. CB1954 (5-aziridinyl-2,4-dinitrobenzamide) is a bioreductive prodrug that can be converted to cytotoxic agent under hypoxic conditions. Upon reduction in the presence of a reductase, its 4-nitro groups is reduced to the corresponding hydroxylamine. Following reaction of the hydroxylamine with acetyl CoA, the latter becomes a potent DNA crosslinking agent. CB1954 is activated by one-electron (1e⁻) reductases, such as the cytochrome P450 reductase, selectively under hypoxic conditions (Walton et al. (1989) *Int. J. Radiat. Oncol. Biol. Phys.*, 16:983-6). CB1954 and analogs are more efficiently activated by rat DT-diaphorase and *E. coli* nitroreductase. Hence, a hypoxia-active agent including CB1954 can be provided as a gene-directed enzyme prodrug therapy (VDEPT), whereby tumor cells are transduced to express *E. coli* nitroreductase or other reductases (Knox et al. (2003) *Curr. Pharm. Des.*, 9:2091-104. The structure of CB1954 is set forth below:

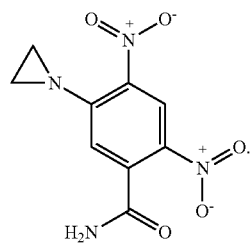

ii. N—[(N,N-dimethylamino)ethyl]carboxamide derivatives

Hypoxia-active agents include N—[(N,N-dimethylamino) ethyl]carboxamide derivatives that are 4-nitroaniline mustards containing a hydrophilic side chains attached via an electron-withdrawing carboxamide group. Such molecules exhibit aqueous solubility and improved cytotoxic potency compared to parent 4-nitroaniline mustards (Palmer et al. (1992) *J. Med. Chem.*, 21:3214-22). Exemplary of such a molecule is SN23862 and related compounds. SN23862 has the structural formula 5-[N,N-bis(2-chloroethyl)amino]-2,4-dinitrobenzamide. SN23862 exhibits increased hypoxic-specific toxicity of about 3.6-fold compared to CB1954.

iii. PR-104 and Related Molecules

PR-104 is a hypoxia-activated alkylating nitrogen mustard prodrug. PR-104 has the chemical formula 2-[-(2-bromoethyl)-2,4-dinitro-6-[[[2-phosphonooxyl]ethyl]amino]carbonyl]aniline]-ethyl methanosulfonate. PR-104 is a pre-prodrug that undergoes a two-step enzymatic activation pathway to generate the active cytotoxic drug PR-104H and its metabolite PR-104 M. First, the water-soluble phosphate ester of PR-104 is cleaved by a phosphatase to yield the metabolite PR-104A. PR-104A is the prodrug, which is subsequently activated by reduction of one or more nitro groups by nitroreductases, including one-electron reductases, to produce the active cytotoxic drug PR-104H which crosslinks DNA. Specifically, in hypoxic regions or tumors, the 5-nitro group of PR-104A is reduced by reductases to the corresponding hydroxylamine (PR-104H) that exerts the cytotoxic effects through activation of the mustard to form DNA interstrand crosslinks. The conversion to the cytotoxic PR-104H product only occurs in the intratumoral environment under hypoxic selective conditions. PR-104H is further reduced to its 5-amine metabolite PR-104 M. PR-104 is more readily reduced in hypoxic cells than SN23862.

The methods of synthesis and activity of PR-104 and related compounds are known in the art (see e.g., Patterson et al. (2007) *Clin. Cancer Research*, 13:3922; International PCT Publication Nos. WO2005/042471, WO2008/033040 and WO2008/033041). Exemplary of such other compounds include, but are not limited to, 2-[Bis(2-bromoethyl)amino]-N-(2-hydroxyethyl)-3,5-dinitrobenzamide phosphate ester (known as SN 28343) and 2-[2-bromoethyl)-2,4-dinitro-3-({[3-(phosphonooxy)propyl]amino}carbonyl)anilino]ethyl methanesulfonate (known as SN29303)

iv. Nitrobenzindoles

Nitrobenzindoles are synthetic analogs of natural antitumor antibiotics CC-1065 and duocarmycin. This class of agents exerts cytotoxicity by adenine-N3 alkylation of the DNA minor groove in a sequence-selective manner, preferentially at AT-rich sites (Boger et al., *Proc. Natl. Acad. Sci.* (1995) 92:3642-3649). Some analogs of CC-1065 and duocarmycin have been modified such that the agent is specifically activated under hypoxia (Tercel et al., *Agnew. Chem. Int. Ed.* (2011) 50:2606-2609). Exemplary nitrobenzindole agents are nitro-1,2-dihydro-3H-benzo[e]indoles, which include the drug SN29730.

SN29730 (2-(1-(chloromethyl)-3-(5-(2-(dimethylamino) ethoxy)indoline-2-carbonyl)-6-nitro-2,3-dihydro-1H-benzo [e]indole-7-sulfonamido)ethyl dihydrogen phosphate) is a chloromethylbenzindoline prodrug that generates a potent DNA minor groove alkylator on nitroreduction upon hypoxic activation (Wilson et al., *Nature Reviews Cancer* (2010, 11:393-410). The structure of SN29730 is set forth below.

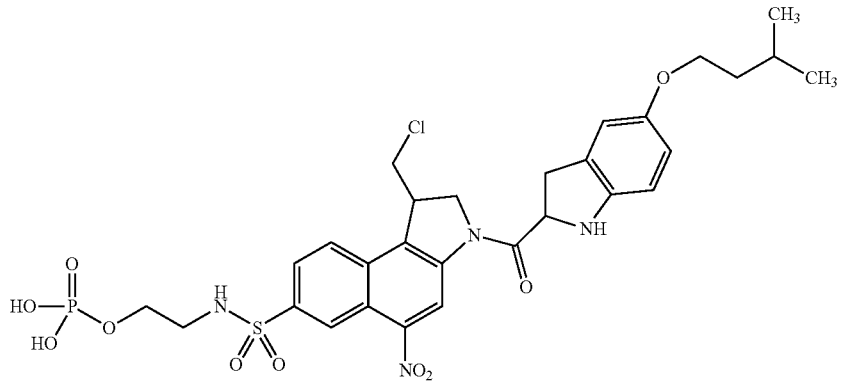 [SMILES: CC(C)CCOc1ccc2c(c1)CC(C(=O)N1CC(CCl)c3c1cc([N+](=O)[O-])c1cc(S(=O)(=O)NCCOP(=O)(O)O)ccc31)N2]

SN29730 can be reduced by the one-electron reductase NADPH-cytochrome P450 reductase (CYPOR), and is further reduced by two-electron reductases to be activated (Wilson et al., *Nature Reviews Cancer* (2010, 11:393-410). The *E. coli* two-electron nitroreductase (NTR) can be used in combination with SN29730 as a gene-directed enzyme prodrug therapy (GDEPT), enhance the activation of the drug by two-electron reduction. SN29730 has high hypoxic selectivity and solubility (Tercel et al., *Agnew. Chem. Int. Ed.* (2011) 50:2606-2609).

SN29730 and related nitrobenzindole compounds are described in U.S. Pat. No. 7,718,688, International PCT Publication Nos. WO 2006043839 and WO 2010027280.

v. 1,2-bis(sulfonyl)hydrazine Prodrugs (SHPs) (e.g., KS119 and Analogs)

1,2-bis(sulfonyl)hydrazine prodrugs (SHPs) are prodrugs of the chloroethylating species 90CE that is an alkylating agent with the ability to cross-link DNA. In particular, 1,2-bis(methylsulfonyl)-2-(2-chloroethyl)-hydrazine carboxylic acid 1-(4-nitrophenyl)ethyl ester (KS119), is an SHP compound that requires enzymatic nitro-reduction to generate the alkylating species 90CE. KS119 also include analogs with altered properties, in particular with improved water-solubility and stability (see e.g U.S. Pat. No. 7,405,317). For example, KS119 is rather insoluble in aqueous solution, in particular at pH 3 to 8. Exemplary of such an analog is a phosphate-bearing analog designated KS119W, and its salt form. Its R-configuration structure of the enantiomer is designated VNP40541. Methods of generating and synthesizing KS119W and its VNP40541 enantiomer are described in U.S. Pat. No. 7,405,317.

The bioconversion of such compounds proceeds via alkaline phosphatase (AP) cleavage of the oxygen-phosphorous bound to form the phenol intermediate. The 2-nitrophenol intermediate then is activated under conditions of hypoxia to generate a hydroxylamine derivate or aniline form and subsequent fragmentation resulting in the formation of the chloroethylating species 90CE. The release of 90CE occurs only on reduction of the nitro group under conditions of hypoxia.

vi. NLCQ-1

Hypoxic-active agents include NLCQ-1 (NSC 709257) and related compounds. NLCQ-1 has the structural formula 4-[3-(2-nitro-1-imidazolyl)-propylamino]-7-chloroquinoline hydrochloride. Like other nitroaromatics, NLCQ-1 is reduced by flavoprotein enzymes, such as P450 cytochrome reductase. NLCQ-1 is a weak DNA-intercalating bioreductive compound, which exhibits sufficient DNA affinity to produce toxicity yet low enough affinity to permit diffusion and penetration to hypoxic tumor tissue (see e.g., Papadopoulou and Bloomer (2003) *Clin. Cancer Res.*, 9:5714). The synthesis and generation of NLCQ-1 is known in the art (see e.g., Papadopoulou et al. (2000) *Oncol. Res.*, 12:185-192; Papadopoulou and Bloomer (2003) *Clin. Cancer Res.*, 9:5714).

f. Transition Metal-Containing Hypoxia-Activated Agents

Nitrogen mustards or benzoindoline compounds can be complexed with transition metals such as cobalt(III) or copper(II). In hypoxia cytotoxic moieties are released through one-electron reductions of the metal centers to unstable cobalt(II) or copper(I) complexes (Wilson et al., *Nature Reviews Cancer* (2010, 11:393-410). Exemplary transition metal-containing hypoxia-activated agent is SN 24771.

SN 24771 ([Co(III)(3-methyl-2,4-pentanedionato)$_2$(N,N-bis(2-chloroethyeethylenediamine)]$^+$, described in U.S. Pat. Nos. 5,348,977 and 5,554,648), is a cobalt (III)-containing nitrogen mustard that releases a diffusable cytotoxic nitrogen mustard in hypoxic environments. The structure of SN 24771 is set forth below.

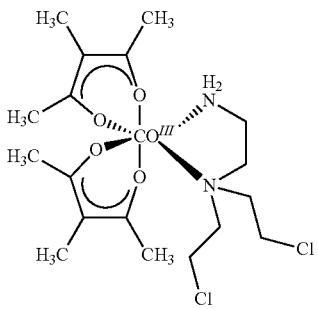

In hypoxia, Co(III) complex of SN 24771 is reduced through one-electron reduction resulting in an unstable Co(II) intermediate, which weakens the Co—N bond and releases the cytotoxic nitrogen mustard, which causes DNA interstrand crosslinks (Wilson et al., *Int J Radial Oncol Biol Phys* (1994) 29:323-327). SN 24771 has a hypoxia specific cytotoxicity of 20-25, and this selectivity occurs through the competition of SN 24771 and O$_2$ for biological reductants (Anderson et al., *British Journal of Cancer* (1996) 27:S48-S51, Ahn et al., *Frontiers in Bioscience* (2007) 12:3483-3501).

2. Prodrugs of Anti-Neoplastic Agents

HAPs also include prodrugs of anti-neoplastic agents containing a hypoxic activator containing a bioreductive group and an anti-neoplastic agent linked by a bioreductively cleavable chemical bridge The anti-neoplastic agent is protected unless exposed to hypoxic conditions where it can be released or generated. For example, under hypoxic conditions the hypoxic activator is activated and pushes electrons into a redox-active linker, thereby releasing or yielding the anti-neoplastic agent or a modified form of the anti-neoplastic agent. The anti-neoplastic agent or modified form thereof then exhibits cytotoxic activity.

In such molecules, the anti-neoplastic agent is protected by a hypoxic activator (Hyp), which is bonded directly or indirectly or through a linker (L) group. For example, one or more hydroxyl, amino groups, mercapto, and/or carboxyl groups present in the anti-neoplastic agent can be protected by a hypoxic activator that is linked directly or indirectly (through a linker) to the hydroxyl, amino, mercapto, and/or carboxyl groups. Such agents can be depicted by the formula Hyp-L-N or Hyp-N, where Hyp is a hypoxic activator containing a bioreductive group, N is an anti-neoplastic agent, and L is a linking group (see e.g., U.S. Pat. No. 7,550,496). During the transformation from a protected anti-neoplastic agent to a cytotoxic prodrug, a hydroxyl group in the anti-neoplastic agent can be transformed, The molecule released upon reduction of the hypoxic activator is either the anti-neoplastic agent or a modified anti-neoplastic agent that includes some or all of the linking group attached to the anti-neoplastic agent.

Thus, the protected anti-neoplastic agent is converted into the corresponding toxic drug in hypoxic tissues by virtue of the activation and reduction of the bioreductive group, resulting in its removal and the concomitant release or generation of the anti-neoplastic agent or a modified version of the anti-neoplastic agent. By virtue of protecting the anti-neoplastic agent, the protected anti-neoplastic agent is much less toxic relative to the drugs to which it is converted into in vivo under hypoxic conditions. For example, that protected anti-neoplastic agent is at least 5-fold, 10-fold, 100-fold, 1000-fold, $10^4$-fold, $10^5$-fold, $10^6$-fold or more less toxic than the anti-neoplastic agent or modified anti-neoplastic agent released under hypoxic conditions.

Hypoxic activator can be any group that is capable of releasing the anti-neoplastic agent or a modified version of the anti-neoplastic agent upon hypoxic reduction of the bioreductive group therein but does not or does not substantially release an anti-neoplastic agent or modified form thereof under normoxic conditions. The released anticancer agent kills cells in and/or near the hypoxic tumor. In such examples, the HAP when activated in hypoxic cells can exhibit bystander effects when the active agent diffuses away to other cells. As described in U.S. Pat. No. 7,550,496, examples of hypoxic activators include, but are not limited to, moieties based on electron deficient nitrobenzenes, electron deficient nitrobenzoic acid amides, nitroazoles, nitroimidazoles, nitrothiophenes, nitrothiazoles, nitrooxazoles, nitrofurans and nitropyrroles where each of these classes or moieties can be substituted or unsubstituted. For example, the moiety can be substituted to provide a redox potential for the group in a range capable of undergoing reduction under hypoxic conditions. One of skill in the art understands how to turn the redox potential of a hypoxic activator by substituting electron withdrawing groups, electron donating groups or a combination thereof. For example, strong electron withdrawing groups include, for example, cyano, sulfone, sulfonamide, carboxamide, or $CF_3$. Milder electron withdrawing groups include, for example, —$CH_2$, —F, —Cl, —Br or by adding a methylene spacer between the hypoxic activator and the strong electron withdrawing group. In one example, the furan, thiophene, thiazole and moieties can be substituted with one or more electron donating groups, including but not limited to methyl or methoxy or amine groups to achieve the desired range of redox potential. In another example, the nitropyrrole moiety can include substitution of an electron withdrawing group including but not limited to cyano, carboxamide, —$CF_3$ and sulfonamide groups to achieve the desired range of redox potential.

In particular examples, the bioreductive group is nitroimidazole or a substituted moiety thereof. The nitroimidazole can be substituted with a variety of groups are known in the art and described in U.S. Pat. No. 7,550,496. Nitroimidazole is, in the absence of oxygen, converted to a free radical containing moiety by a cytochrome 450 reductase. If the nitroimidazole is appropriately covalently bound to another moiety, further reduction of the free radical form of nitroimidazole can lead to release of that moiety. In the presence of oxygen, however, the free radical reacts with oxygen to form superoxide and the parent nitroimidazole.

If the molecule containing a linking group L, the linking group is a group that is capable of being cleaved from the bioreductive group upon reduction yielding a modified anti-neoplastic agent that is either itself a neoplastic agent or through rearrangement, degradation or other chemical modification yields a neoplastic agent. Exemplary linkers are known in the art and described in U.S. Pat. No. 7,550,496.

The anti-neoplastic agent or anti-cancer agent can be an anti-angiogenic agent, alkylating agents, antimetabolite, microtubulin polymerization perturbers (e.g., a taxane), platinum coordination complexes, anthracenediones, substituted ureas, methylhydrazine derivatives, adrenocortical suppressants, hormones and antagonists, anti-cancer polysaccharides and others known in the art. For example, an anti-neoplastic agent or anti-cancer agent can be an anthracycline, which is a class of cytotoxic antibiotics. Anthracyclines include, but are not limited to, aclarubicin, daunorubicin, doxorubicin, epirubicin, idarubicin, mitoxantrone, pirarubicin, valrubicin, and any analog thereof. Anthracycline analogs are well known in the art. Other anti-neoplastic or anti-cancer agents include alkylating agents (alkylators or mustards), such as phosphoramidate-based alkylators, for example, cyclophosphamide or ifosfamide or analogs thereof. Other exemplary anti-neoplastic or anti-cancer agents include, but are not limited to, maytansine, enediyenes, discodermolide, epothilone, taxane, calicheamicin, tedanolide, etoposide, vinblastine, vincristine, topotecan, 5-fluorouracil or prodrugs thereof, camptothecin, bleomycins, calicheamicins, colchicine, cyanamide, dacarbazine, dactinomycin, discodermolide, epothilones, etoposide, Combretastatin A-4, fludarabine, hydroxyurea, hydroxyureapentostatin, maytansine, 6-mercaptopurine, methotrexate, mitomycin, carboplatin, cisplatin, prednisone, procarbazine, taxanes such as docetaxel and paclitaxel, tedanolide, teniposide, 6-thioguanine, topotecan and vinca alkaloids such as vinblastine and vincristine and analogs of any of the foregoing.

Various classes of HAPs that are prodrugs containing a protected anti-neoplastic agent, including HAPs of different chemical structure classes and cytotoxic mechanisms, are known in the art. Non-limiting examples of such classes of agents are described below.

a. Phosphoramidate Alkylator Prodrugs

Hypoxic active agents include phosphoramidate alkylator prodrugs, for example, any described in International PCT Publication Nos. WO2008/083101, WO2010/048330, WO2007/002931, WO2012/006032; and Duan et al. (2008) J. Med. Chem., 51:2412-2420. Phosphoramide alkylators include 5-nitrothiophene-, 5-nitrofuran and 2-nitroimidazole prodrugs of phosphoramidate toxins. Phosphoramidate alkylators include those derived or designed based on the phosphoramide-based, DNA-crosslinking bis-alkylator mustards such as ifosfamide and cyclophosphamide. Non-limiting examples of such prodrugs include TH-281, TH-302, TH-308 or derivatives or analogs thereof or related compounds of Formula I as described in the above references.

i. TH-302

TH-302 is a derivative or analog of TH-281 that contains replacement of the chlorines in the alkylator portion of TH-281 with bromines. Hence, it is also is a 2-nitroimidazole prodrug of the cytotoxin bromo-isophosphoramide mustard (Br-IPM). The structural formula of TH-302 is N,N'-bis(2-bromoethyl)phosphorodiamidic acid (1-methyl-2-nitro-1H-imidazol-5-yl)methyl ester. TH-302 exhibits a 10-fold improved potency compared to TH-281. TH-302 exhibits hypoxia-selective cytotoxicity across a range of cancer cell lines in vitro and in vivo. The structure of TH-302 is set forth below:

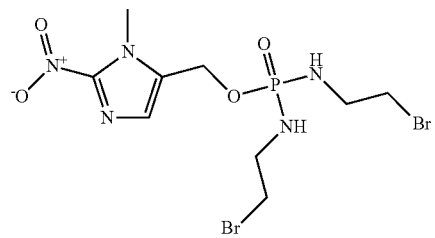

Methods of synthesizing, formulating and using TH-302 and related analogs are well known in the art (see e.g., U.S. Pat. No. 7,550,496 and International PCT Publication No. WO2007/002931, WO2008/083101; WO2010/048330; and U.S. Patent Pub. No. US2011/042047, including any related compound of Formula I described therein).

b. Camptothecin Prodrug Derivatives

Camptothecin is a cytotoxin that inhibits topoisomerase I, an enzyme essential for DNA synthesis, and was first isolated from the leaves of the Camptotheca acuminata tree. Camptothecin exhibits anti-cancer activity but is poorly soluble and generates adverse drug reactions. Prodrugs of camptothecin active under hypoxic conditions have been developed and include camptothecin derivatives as set forth in WO2010/148138. Such derivatives include 14-nitro, 14-amino, and 14-substituted amino camptothecin derivatives as described in WO2010/148138 or salts thereof. Such compounds include, but are not limited to TH1320, TH1332, TH1338, TH1339, TH1346, TH1431, such as TH1332 and TH1431. As described in WO2010/148138, the 14-nitro camptothecin derivatives can be prepared by reacting a camptothecin derivative with fuming nitric acid, and optionally using acetic anhydride as a solvent.

c. Pan-Her Inhibitor Prodrug

Irreversible pan-Her inhibitors include, but are not limited to, HKI-272, BIBW-2992, PF299, SN29926, PR509E. These pan-Her inhibitors inhibit one or more Her-family receptors including Her1, Her2, Her3 and EGFR. Prodrugs of pan-Her inhibitors include those in which the pan-Her inhibitor is only active in the hypoxic condition of the tumor. Exemplary of such prodrugs are derivatives of SN29926 that are five nitromethylaryl quaternary ammonium bromide prodrugs of SN29966 with five nitroheterocyclic alpha-methyl bromides. The prodrugs are not active under normoxic conditions, fragment following one-electron reduction in an oxygen-inhibited manner to release the irreversible pan-Her inhibitor and display anti-proliferative activity under hypoxia (Smaill et al. (2009) Mol. Cancer. Ther., (2009) 8(12 Suppl):C46). Non-limiting examples of pan-Her inhibitor prodrugs are prodrug SN29965 and prodrug SN29966 (Smaill et al. (2009) Mol. Cancer. Ther., (2009) 8(12 Suppl):C46), SN32807 (PR509) and PR610 (pan-erbB inhibitor) and SN34003 (pan Her-2 inhibitor). Many of these molecules, including PR509, PR610 and SN34003 are being developed by ProActa (San Diego, Calif.) and are in clinical trials.

3. Conjugates

Any of the hypoxia-activated agents can be provided as a conjugate that is linked directly or indirectly to a tumor-targeting moiety. A tumor-targeting moiety can be any moiety that selectively targets or localizes the agent to a selected tumor cell. Such targeting molecules include cell-targeting moieties that enhances the association of the agent or complex with a cell including, but not limited to, protein, peptide, lipid, steroid, sugar, carbohydrate, (non-expressing) polynucleic acid or synthetic compound. For example, targeted delivery, can be achieved by incorporating cell binding ligands that recognize target-specific cellular receptors and/or enhance cellular binding to receptors. Such ligands include, but are not limited to, insulin, growth factor (e.g., EGF of FGF), transferrin, peptides that include the RGD sequence. Other targeting moieties include, but are not limited to, chemical groups that react with thiol, sulfhydryl or disulfide groups on cells, folate and other vitamins. Exemplary targeting moieties are biomacromolecules described in U.S. Patent Pub. No. US20080306248 that include, but are not limited to, Po-transferrin, Fe-transferrin, Ru-transferrin, Ti-transferrin, Ga-transferrin, Pt-transferrin, somatostatin, EGF, folacin acid or transcobalamin.

F. ANTI-HYALURONAN AGENT THERAPY

Anti-hyaluronan agents include agents that inhibit hyaluronan synthesis or degrade hyaluronan. Anti-hyaluronan agents, such as hyaluronan degrading enzymes, can be used to treat hyperproliferative diseases and conditions, including tumors and cancers or inflammatory diseases or conditions. For example, HA accumulation, such as by altered hyaluronan metabolism, distribution and function is associated with arthritis, immune and inflammatory disorders, pulmonary and vascular diseases and cancer (Morohashi et al. (2006) *Biochem. Biophys. Res. Comm.*, 345:1454-1459). Such diseases can be treated by inhibiting HA synthesis or degrading HA (see e.g., Morohashi 2006; U.S. Patent Publication No. 20100003238 and International PCT Publication No WO 2009/128917). In some examples, such treatments that reduce hyaluronan levels on cells and tissues can be associated with adverse side effects, such as musculoskeletal side effects. Hence, treatment with an anti-hyaluronan-agent can further include treatment with a corticosteroid to ameliorate or reduce such side effects.

Therapeutically effective concentration of anti-hyaluronan agents can be determined empirically by testing the compounds in known in vitro and in vivo systems, such as the assays provided herein. For example, the concentration of an anti-hyaluronan agent, for example a hyaluronan degrading enzyme (e.g., a hyaluronidase), such as PEGylated hyaluronidase depends on absorption, inactivation and excretion rates, the physicochemical characteristics, the dosage schedule, and amount administered as well as other factors known to those of skill in the art. For example, it is understood that the precise dosage and duration of treatment is a function of the tissue being treated, the disease or condition being treated, the route of administration, the patient or subject and the particular anti-hyaluronan agent and can be determined empirically using known testing protocols or by extrapolation from in vivo or in vitro test data and/or can be determined from known dosing regimes of the particular agent. Standard clinical techniques, in vitro assays and animal models can be employed to help identify optimal dosage ranges. The precise dosage, which can be determined empirically, can depend on the particular enzyme, the route of administration, the type of disease to be treated and the seriousness of the disease.

For example, methods of using anti-hyaluronan agents, such as hyaluronan-degrading enzymes or modified forms thereof (e.g., PEGylated forms) for treatment of hyperproliferative diseases and conditions are well known in the art (see e.g., U.S. Patent Publication No. 20100003238 and International PCT Publication No. WO 2009/128917). Thus, dosages of an anti-hyaluronan agent, such as a hyaluronan-degrading enzyme for example a hyaluronidase can be chosen based on standard dosing regimes for that agent under a given route of administration.

Examples of effective amounts of an anti-hyaluronan agent for treatment of a hyperproliferative disease or condition is a dose ranging from 0.01 µg to 100 g per kg of body weight. For example, an effective amount of an anti-hyaluronan agent is a dose ranging from 0.01 µg to 100 mg per kg of body weight, such as 0.01 µg to 1 mg per kg of body weight, 1 µg to 100 µg per kg of body weight, 1 µg to 10 µg per kg of body weight or 0.01 mg to 100 mg per kg of body weight. For example, effective amounts include at least or about at least or about or 0.01 µg, 0.05, 0.1, 0.5, 1, 2, 3, 4, 5, 6, 7, 8, 9, 10, 20, 25, 30, 35, 40, 45, 50, 55, 60, 65, 70, 75, 80, 85, 90, 95, 100, 200, 300, 400, 500, 600, 700, 800, 900 or 1000 µg/kg body weight Other examples of effective amounts include 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1.0, 2, 3, 4, 5, 6, 7, 8, 9, 10, 20, 25, 30, 35, 40, 45, 50, 55, 60, 65, 70, 75, 80, 85, 90, 95 or 100 g/kg body weight. For example, an anti-hyaluronan agent, such as a hyaluronan-degrading enzyme for example a hyaluronidase (e.g., a PEGylated hyaluronidase such as a PEGPH20), can be administered at or about 0.1 µg/kg to 1 mg/kg, for example 0.5 µg/kg to 100 µg/kg, 0.75 µg/kg to 15 µg/kg, 0.75 µg/kg to 7.5 µg/kg or 1.0 µg/kg to 3.0 µg/kg. In other examples, an anti-hyaluronan agent such as a hyaluronan-degrading enzyme for example a hyaluronidase (e.g., a PEGylated hyaluronidase such as a PEGPH20), can be administered at or 1 mg/kg to 500 mg/kg, for example, 100 mg/kg to 400 mg/kg, such as 200 mg/kg. Generally, compositions contain 0.5 mg to 100 grams of anti-hyaluronan agent, for example, 20 µg to 1 mg, such as 100 µg to 0.5 mg or can contain 1 mg to 1 gram, such as 5 mg to 500 mg.

The dose or compositions can be for single dosage administration or for multiple dosage administration. The dose or composition can be administered in a single administration once, several times a week, twice weekly, every 15 days, 16 days, 17, 18, 19, 20, 21, 22, 23, 24, 25, 26, 27, 28, 29, or 30 days, once monthly, several times a year or yearly. In other examples, the dose or composition can be divided up and administered once, several times a week, twice weekly, every 15 days, 16 days, 17, 18, 19, 20, 21, 22, 23, 24, 25, 26, 27, 28, 29, or 30 days, once monthly, several times a year or yearly. Anti-hyaluronan compositions can be formulated as liquid compositions or can be lyophilized. The compositions also can be formulated as a tablet or capsule.

1. Agents that Inhibit Hyaluronan Synthesis

HA can be synthesized by three enzymes that are the products of three related mammalian genes identified as HA synthases, designated has-1, has-2 and has-3. Different cell types express different HAS enzymes and expression of HAS mRNAs is correlated with HA biosynthesis. It is known that silencing HAS genes in tumor cells inhibits tumor growth and metastasis. An anti-hyaluronan agent includes any agent that inhibits, reduces or downregulates the expression or level of an HA synthase. Such agents are known to one of skill in the art or can be identified.

For example, downregulation of a HAS can be accomplished by providing oligonucleotides that specifically hybridize or otherwise interact with one or more nucleic acid molecules encoding an HAS. For example, anti-hyaluronan agents that inhibit hyaluronan synthesis include antisense or sense molecules against an has gene. Such antisense or sense inhibition is typically based upon hydrogen bonding-based hybridization of oligonucleotide strands or segments such that at least one strand or segment is cleaved, degraded or otherwise rendered inoperable. In other examples, post-transcriptional gene silencing (PTGS), RNAi, ribozymes and DNAzymes can be employed. It is within the level of one skill in the art to generate such constructs based on the sequence of HAS1 (set forth in SEQ ID NO:219), HAS2 (set forth in SEQ ID NO:220) or HAS3 (set forth in SEQ ID NO:221). It is understood in the art that the sequence of an antisense or sense compound need not be 100% complementary to that of its target nucleic acid to be specifically hybridizable. Moreover, an oligonucleotide may hybridize over one or more segments such that intervening or adjacent segments are not involved in the hybridization event (e.g., a loop structure or hairpin structure). Generally, the antisense or sense compounds have at least 70% sequence complementarity to a target region within the target nucleic acid, for example, 75% to 100% complementarity, such as 75%, 80%, 85%, 90%, 95% or 100%. Exemplary sense or antisense molecules are known in the art (see e.g., Chao et al. (2005) *J. Biol. Chem.*, 280:27513-27522; Simpson et al. (2002) *J. Biol. Chem.*, 277:10050-10057; Simpson et al. (2002) *Am. J. Path.*, 161:849; Nishida et al. (1999) *J. Biol. Chem.*, 274:21893-21899; Edward et al. (2010) *British J Dermatology*, 162:1224-1232; Udabage et al. (2005) Cancer Res., 65:6139; and U.S. Patent Publication No. US20070286856).

Another exemplary anti-hyaluronan agent that is an HA synthesis inhibitor is 4-methylumbelliferone (4-MU; 7-hydroxy-4-methylcoumarin) or a derivative thereof. 4-MU acts by reducing the UDP-GlcUA precursor pool that is required for HA synthesis. For example, in mammalian cells, HA is synthesized by HAS using UDP-glucuronic acid (UGA) and UDP-N-acetyl-D-glucosamine precursors. 4-MU interferes with the process by which UGA is generated, thereby depleting the intracellular pool of UGA and resulting in inhibition of HA synthesis. 4-MU is known to have antitumor activity (see e.g., Lokeshwar et al. (2010) Cancer Res., 70:2613-23; Nakazawa et al. (2006) Cancer Chemother. Pharmacol., 57:165-170; Morohashi et al. (2006) Biochem. Biophys. Res. Comm., 345-1454-1459). Oral administration of 4-MU at 600 mg/kg/d reduces metastases by 64% in the B16 melanoma model (Yoshihara et al. (2005) FEBS Lett., 579:2722-6). The structure of 4-MU is set forth below. Also, derivatives of 4-MU exhibit anti-cancer activity, in particular 6,7-dihydroxy-4-methyl coumarin and 5,7-dihydroxy-4-methyl coumarin (see e.g., Morohashi et al. (2006) Biochem. Biophys. Res. Comm., 345-1454-1459).

4-Methylumbelliferone (4-MU; $C_{10}H_8O_3$)

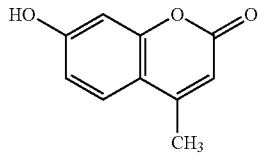

Further exemplary anti-hyaluronan agents are tyrosine kinase inhibitors, such as Leflunomide (Arava), genistein or erbstatin. Leflunomide also is a pyrimidine synthesis inhibitor. Leflunomide is a known drug for the treatment of Rheumatoid arthritis (RA), and also is effective in treating the rejection of allografts as well as xenografts. HA is known to directly or indirectly contribute to HA (see e.g., Stuhlmeier (2005) *J. Immunol.*, 174:7376-7382). Tyrosine kinase inhibitors inhibit HAS1 gene expression (Stuhlmeier 2005).

In one example, leflunomide, or derivatives thereof, generally are available as tablets containing 1-100 mg of active drug, for example, 1, 5, 10, 20, 30, 40, 50, 60, 70, 80, 90 or 100 mg of drug. For the treatment of a hyperproliferative disease and conditions, for example Rheumatoid arthritis, it is administered at 10 to 500 mg per day, typically 100 mg per day. The dosage can be continued as needed for treatment of the disease or conditions, or can be tapered or reduced to successively lower doses. For example, for treatment of Rheumatoid arthritis, leflunomide can be administered at an initial loading dose of 100 mg per day for three days and then administered at a continued dose of 20 mg/day.

2. Hyaluronan-Degrading Enzyme

Hyaluronan is an essential component of the extracellular matrix and a major constituent of the interstitial barrier. By catalyzing the hydrolysis of hyaluronan, hyaluronan-degrading enzymes lower the viscosity of hyaluronan, thereby increasing tissue permeability and increasing the absorption rate of fluids administered parenterally. As such, hyaluronan-degrading enzymes, such as hyaluronidases, have been used, for example, as spreading or dispersing agents in conjunction with other agents, drugs and proteins to enhance their dispersion and delivery.

Hyaluronan degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating $\beta$-3$\propto$4 and $\beta$-1→6 glycosidic bonds. Hyaluronan chains can reach about 25,000 disaccharide repeats or more in length and polymers of hyaluronan can range in size from about 5,000 to 20,000,000 Da in vivo. Accordingly, hyaluronan degrading enzymes for the uses and methods provided include any enzyme having the ability to catalyze the cleavage of a hyaluronan disaccharide chain or polymer. In some examples the hyaluronan degrading enzyme cleaves the $\beta$-1→4 glycosidic bond in the hyaluronan chain or polymer. In other examples, the hyaluronan degrading enzyme catalyze the cleavage of the $\beta$-1→6 glycosidic bond in the hyaluronan chain or polymer.

Hence, hyaluronan degrading enzymes, such as hyaluronidases, are a family of enzymes that degrade hyaluronic acid, which is an essential component of the extracellular matrix and a major constituent of the interstitial barrier. By catalyzing the hydrolysis of hyaluronic acid, a major constituent of the interstitial barrier, hyaluronan degrading enzymes lower the viscosity of hyaluronic acid, thereby increasing tissue permeability. As such, hyaluronan degrading enzymes, such as hyaluronidases, have been used, for example, as a spreading or dispersing agent in conjunction with other agents, drugs and proteins to enhance their dispersion and delivery. Hyaluronan-degrading enzymes also are used as an adjuvant to increase the absorption and dispersion of other injected drugs, for hypodermoclysis (subcutaneous fluid administration), and as an adjunct in subcutaneous urography for improving resorption of radiopaque agents. Hyaluronan-degrading enzymes, for example, hyaluronidase can be used in applications of ophthalmic procedures, for example, peribulbar and sub-Tenon's block in local anesthesia prior to ophthalmic surgery. Hyaluronidase also can be used in other therapeutic and cosmetic uses, for example, by promoting akinesia in cosmetic surgery, such as blepharoplasties and face lifts.

Various forms of hyaluronan degrading enzymes, including hyaluronidases have been prepared and approved for therapeutic use in subjects, including humans. The provided compositions and methods can be used, via these and other therapeutic uses, to treat hyaluronan-associated diseases and conditions. For example, animal-derived hyaluronidase preparations include Vitrase (ISTA Pharmaceuticals), a purified ovine testicular hyaluronidase, Amphadase (Amphastar Pharmaceuticals), a bovine testicular hyaluronidase and Hydase (Prima Pharm Inc.), a bovine testicular hyaluronidase. It is understood that any animal-derived hyaluronidase preparation can be used in the methods and uses provided herein (see, e.g., U.S. Pat. Nos. 2,488,564, 2,488,565, 2,676,139, 2,795,529, 2,806,815, 2,808,362, 5,747,027 and 5,827,721 and Internation PCT Publication No. WO2005/118799). Hylenex (Halozyme Therapeutics) is a human recombinant hyaluronidase produced by genetically engineered Chinese Hamster Ovary (CHO) cells containing nucleic acid encoding soluble forms of PH20, designated rHuPH20.

Exemplary of hyaluronan degrading enzymes in the compositions and methods provided herein are soluble hyaluronidases. Other exemplary hyaluronan degrading enzymes include, but are not limited to particular chondroitinases and lyases that have the ability to cleave hyaluronan.

As described below, hyaluronan-degrading enzymes exist in membrane-bound or soluble forms that are secreted from cells. For purposes herein, soluble hyaluronan-degrading enzymes are provided for use in the methods, uses, compositions or combinations herein. Thus, where hyaluronan-degrading enzymes include a glycosylphosphatidylinositol (GPI) anchor and/or are otherwise membrane-anchored or insoluble, such hyaluronan-degrading enzymes are provided herein in soluble form by truncation or deletion of the GPI anchor to render the enzyme secreted and soluble. Thus, hyaluronan-degrading enzymes include truncated variants, e.g., truncated to remove all or a portion of a GPI anchor. Hyaluronan-degrading enzymes provided herein also include allelic or species variants or other variants, of a soluble hyaluronan-degrading enzyme. For example, hyaluronan degrading enzymes can contain one or more variations in its primary sequence, such as amino acid substitutions, additions and/or deletions. A variant of a hyaluronan-degrading enzyme generally exhibits at least or about 60%, 70%, 80%, 90%, 91%, 92%, 93%, 94%, 95%, 96%, 97%, 98%, 99% or more sequence identity compared to the hyaluronan-degrading enzyme not containing the variation. Any variation can be included in the hyaluronan degrading enzyme for the purposes herein provided the enzyme retains hyaluronidase activity, such as at least or about 5%, 10%, 15%, 20%, 25%, 30%, 35%, 40%, 45%, 50%, 55%, 60%, 65%, 70%, 75%, 80%, 85%, 90%, 95% or more of the activity of a hyaluronan degrading enzyme not containing the variation (as measured by in vitro and/or in vivo assays well known in the art and described herein).

Where the methods and uses provided herein describe the use of a soluble hyaluronidase, accordingly any hyaluronan degrading enzyme, generally a soluble hyaluronan degrading enzyme, can be used. It is understood that any hyaluronidase can be used in the methods and uses provided herein (see, e.g., U.S. Pat. No. 7,767,429 and U.S. Patent Publication Nos. US20040268425 and US20100143457).

a. Hyaluronidases

Hyaluronidases are members of a large family of hyaluronan degrading enzymes. There are three general classes of hyaluronidases: mammalian-type hyaluronidases, bacterial hyaluronidases and hyaluronidases from leeches, other parasites and crustaceans. Such enzymes can be used in the compositions, combinations and methods provided herein.

i. Mammalian-type Hyaluronidases

Mammalian-type hyaluronidases (EC 3.2.1.35) are endo-/β-N-acetyl-hexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Hyaluronidases of this type include, but are not limited to, hyaluronidases from cows (bovine) (SEQ ID NOS: 10, 11 and 64 and BH55 (U.S. Pat. Nos. 5,747,027 and 5,827,721), nucleic acid molecules set forth in SEQ ID NOS: 190-192), sheep (*Ovis aries*) (SEQ ID NO:26, 27, 63 and 65, nucleic acid molecules set forth in SEQ ID NOS: 66 and 193-194), yellow jacket wasp (SEQ ID NOS: 12 and 13), honey bee (SEQ ID NO:14), white-face hornet (SEQ ID NO:15), paper wasp (SEQ ID NO:16), mouse (SEQ ID NOS: 17-19, 32), pig (SEQ ID NOS: 20-21), rat (SEQ ID NOS: 22-24, 31), rabbit (SEQ ID NO:25), orangutan (SEQ ID NO:28), cynomolgus monkey (SEQ ID NO:29), guinea pig (SEQ ID NO:30), chimpanzee (SEQ ID NO:101), rhesus monkey (SEQ ID NO:102), and human hyaluronidases (SEQ ID NOS: 1-2, 36-39). Exemplary of hyaluronidases in the compositions, combinations and methods provided herein are soluble hyaluronidases.

Mammalian hyaluronidases can be further subdivided into those that are neutral active, predominantly found in testes extracts, and acid active, predominantly found in organs such as the liver. Exemplary neutral active hyaluronidases include PH20, including but not limited to, PH20 derived from different species such as ovine (SEQ ID NOS: 27, 63 and 65), bovine (SEQ ID NO:11 and 64) and human (SEQ ID NO:1). Human PH20 (also known as SPAM1 or sperm surface protein PH20), is generally attached to the plasma membrane via a glycosylphosphatidyl inositol (GPI) anchor. It is naturally involved in sperm-egg adhesion and aids penetration by sperm of the layer of cumulus cells by digesting hyaluronic acid.

Besides human PH20 (also termed SPAM1), five hyaluronidase-like genes have been identified in the human genome, HYAL1, HYAL2, HYAL3, HYAL4 and HYALP1. HYALP1 is a pseudogene, and HYAL3 (SEQ ID NO:38) has not been shown to possess enzyme activity toward any known substrates. HYAL4 (precursor polypeptide set forth in SEQ ID NO:39) is a chondroitinase and exhibits little activity towards hyaluronan. HYAL1 (precursor polypeptide set forth in SEQ ID NO:36) is the prototypical acid-active enzyme and P1120 (precursor polypeptide set forth in SEQ ID NO:1) is the prototypical neutral-active enzyme. Acid-active hyaluronidases, such as HYAL1 and HYAL2 (precursor polypeptide set forth in SEQ ID NO:37) generally lack catalytic activity at neutral pH (i.e., pH 7). For example, HYAL1 has little catalytic activity in vitro over pH 4.5 (Frost et al. (1997) *Anal. Biochem.* 251:263-269). HYAL2 is an acid-active enzyme with a very low specific activity in vitro. The hyaluronidase-like enzymes also can be characterized by those which are generally attached to the plasma membrane via a glycosylphosphatidyl inositol (GPI) anchor such as human HYAL2 and human PH20 (Danilkovitch-Miagkova et al. (2003) *Proc Natl Acad Sci USA* 100(8):4580-5), and those which are generally soluble such as human HYAL1 (Frost et al. (1997) *Biochem Biophys Res Commun.* 236(1):10-5).

PH20

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. It has both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acid pH. In addition to being a hyaluronidase, PH20 also appears to be a receptor for HA-induced cell signaling, and a receptor for the zona pellucida surrounding the oocyte.

Exemplary PH20 proteins include, but are not limited to, human (precursor polypeptide set forth in SEQ ID NO:1, mature polypeptide set forth in SEQ ID NO:2), chimpanzee (SEQ ID NO:101), Rhesus monkey (SEQ ID NO:102) bovine (SEQ ID NOS: 11 and 64), rabbit (SEQ ID NO:25), ovine PH20 (SEQ ID NOS: 27, 63 and 65; encoding DNA set forth in SEQ ID NO:66), Cynomolgus monkey (SEQ ID NO:29), guinea pig (SEQ ID NO:30), rat (SEQ ID NO:31) and mouse (SEQ ID NO:32) PH20 polypeptides. PH20 variants also are known in the art and include, but are not limited to a polypeptide set forth in SEQ ID NO:50 or 51.

Bovine PH20 is a 553 amino acid precursor polypeptide (SEQ ID NO:11). Alignment of bovine PH20 with the human PH20 shows only weak homology, with multiple gaps existing from amino acid 470 through to the respective carboxy termini due to the absence of a GPI anchor in the bovine polypeptide (see e.g., Frost GI (2007) *Expert Opin. Drug. Deliv.* 4: 427-440). In fact, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) *Biol Reprod.* 65(2):628-36). This unique feature of bovine hyaluronidase has permitted the use of the soluble bovine testes hyaluronidase enzyme as an extract for clinical use (Wydase®, Hyalase®).

The human PH20 mRNA transcript is normally translated to generate a 509 amino acid precursor polypeptide (SEQ ID NO:1) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 therefore, is a 474 amino acid polypeptide set forth in SEQ ID NO:2. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO:1. Thus, a 474 amino acid GPI-anchored mature polypeptide with an amino acid sequence set forth in SEQ ID NO:2 is produced.

Human PH20 exhibits hyaluronidase activity at neutral and acid pH. In one aspect, human PH20 is the prototypical neutral-active hyaluronidase that is generally locked to the plasma membrane via a GPI anchor. In another aspect, PH20 is expressed on the inner acrosomal membrane where it has hyaluronidase activity at neutral and acid pH. It appears that PH20 contains two catalytic sites at distinct regions of the polypeptide: the Peptide 1 and Peptide 3 regions (Chem et al. (2001) *Matrix Biology* 20:515-525). Evidence indicates that the Peptide 1 region of PH20, which corresponds to amino acid positions 107-137 of the mature polypeptide set forth in SEQ ID NO:2 and positions 142-172 of the precursor polypeptide set forth in SEQ ID NO:1, is required for enzyme activity at neutral pH. Amino acids at positions 111 and 113 (corresponding to the mature PH20 polypeptide set forth in SEQ ID NO:2) within this region appear to be important for activity, as mutagenesis by amino acid replacement results in PH20 polypeptides with 3% hyaluronidase activity or undetectable hyaluronidase activity, respectively, compared to the wild-type PH20 (Arming et al., (1997) *Eur. J. Biochem.* 247: 810-814).

The Peptide 3 region, which corresponds to amino acid positions 242-262 of the mature polypeptide set forth in SEQ ID NO:2, and positions 277-297 of the precursor polypeptide set forth in SEQ ID NO:1, appears to be important for enzyme activity at acidic pH. Within this region, amino acids at positions 249 and 252 of the mature PH20 polypeptide appear to be essential for activity, and mutagenesis of either one results in a polypeptide essentially devoid of activity (Arming et al., (1997) *Eur. J. Biochem.* 247:810-814).

In addition to the catalytic sites, PH20 also contains a hyaluronan-binding site. Experimental evidence indicate that this site is located in the Peptide 2 region, which corresponds to amino acid positions 205-235 of the precursor polypeptide set forth in SEQ ID NO:1 and positions 170-200 of the mature polypeptide set forth in SEQ ID NO:2. This region is highly conserved among hyaluronidases and is similar to the heparin binding motif. Mutation of the arginine residue at position 176 (corresponding to the mature PH20 polypeptide set forth in SEQ ID NO:2) to a glycine results in a polypeptide with only about 1% of the hyaluronidase activity of the wild type polypeptide (Arming et al., (1997) Eur. J. Biochem. 247:810-814).

There are seven potential glycosylation sites in human PH20 at N82, N166, N235, N254, N368, N393, S490 of the polypeptide exemplified in SEQ ID NO:1. Because amino acids 36 to 464 of SEQ ID NO:1 appear to contain the minimally active human PH20 hyaluronidase domain, the O-linked glycosylation site S490 is not required for proper hyaluronidase activity. There are six disulfide bonds in human PH20. Two disulfide bonds between the cysteine residues C60 and C351 and between C224 and C238 of the polypeptide exemplified in SEQ ID NO:1 (corresponding to residues C25 and C316, and C189 and C203 of the mature polypeptide set forth in SEQ ID NO:2, respectively). A further four disulfide bonds are formed between the cysteine residues C376 and C387; between C381 and C435; between C437 and C443; and between C458 and C464 of the polypeptide exemplified in SEQ ID NO:1 (corresponding to residues C341 and C352; between C346 and C400; between C402 and C408; and between C423 and C429 of the mature polypeptide set forth in SEQ ID NO:2, respectively).

ii. Other Hyaluronidases

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria for use in the compositions, combinations and methods provided include, but are not limited to, hyaluronan degrading enzymes in microorganisms, including strains of *Arthrobacter, Bdellovibrio, Clostridium, Micrococcus, Streptococcus, Peptococ-*

*cus, Propionibacterium, Bacteroides,* and *Streptomyces.* Particular examples of such strains and enzymes include, but are not limited to *Arthrobacter* sp. (strain FB24 (SEQ ID NO:67)), *Bdellovibrio bacteriovorus* (SEQ ID NO:68), *Propionibacterium acnes* (SEQ ID NO:69), *Streptococcus agalactiae* (SEQ ID NO:70); 18RS21 (SEQ ID NO:71); serotype Ia (SEQ ID NO:72); serotype III (SEQ ID NO:73), *Staphylococcus aureus* (strain COL (SEQ ID NO:74); strain MRSA252 (SEQ ID NOS: 75, 76 and 89); strain MSSA476 (SEQ ID NO:77); strain NCTC 8325 (SEQ ID NO:78); strain bovine RF122 (SEQ ID NOS: 79 and 80); strain USA300 (SEQ ID NO:81), *Streptococcus pneumoniae* ((SEQ ID NO:82); strain ATCC BAA-255/R6 (SEQ ID NO:83); serotype 2, strain D39/NCTC 7466 (SEQ ID NO:84), *Streptococcus pyogenes* (serotype (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096; serotype M12, strain MGAS9429 (SEQ ID NOS: 90 and 91); serotype M28 (SEQ ID NO:92); *Streptococcus suis* (SEQ ID NOS: 93-95); *Vibrio fischeri* (strain ATCC 700601/ES114 (SEQ ID NO:96)), and the *Streptomyces* hyaluronolyticus hyaluronidase enzyme, which is specific for hyaluronic acid and does not cleave chondroitin or chondroitin sulfate (Ohya, T. and Kaneko, Y. (1970) *Biochim. Biophys. Acta* 198:607).

Hyaluronidases from leeches, other parasites, and crustaceans (EC 3.2.1.36) are endo-β-glucuronidases that generate tetra- and hexasaccharide end-products. These enzymes catalyze hydrolysis of 1→3-linkages between β-D-glucuronate and N-acetyl-D-glucosamine residues in hyaluronate. Exemplary hyaluronidases from leeches include, but are not limited to, hyaluronidase from Hirudimidae (e.g., *Hirudo medicinalis*), Erpobdellidae (e.g., *Nephelopsis obscura* and *Erpobdella punctata*), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol. Biol.* 124(3):319-26). An exemplary hyaluronidase from bacteria that has the same mechanism of action as the leech hyaluronidase is that from the cyanobacteria, *Synechococcus* sp. (strain RCC307, SEQ ID NO:97).

b. Other Hyaluronan Degrading Enzymes

In addition to the hyaluronidase family, other hyaluronan degrading enzymes can be used in the compositions, combinations and methods provided. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, combinations, and methods provided are known in the art (e.g., U.S. Pat. No. 6,054,569; Yamagata, et al. (1968) *J. Biol. Chem.* 243(7): 1523-1535; Yang et al. (1985) *J. Biol. Chem.* 160(30): 1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J Biol. Chem.* 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem.* 272: 9123-9130). Exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO:98 (Sato et al. (1994) *Appl. Microbiol. Biotechnol.* 41(1):39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Flavobacterium heparinum* and *Victivallis vadensis*, set forth in SEQ ID NOS: 99 and 100, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-OS). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133).

c. Soluble Hyaluronan Degrading Enzymes

Provided in the compositions, combinations, uses and methods herein are soluble hyaluronan degrading enzymes, including soluble hyaluronidases. Soluble hyaluronan degrading enzymes include any hyaluronan degrading enzymes that are secreted from cells (e.g., CHO cell) upon expression and exist in soluble form. Such enzymes include, but are not limited to, soluble hyaluronidases, including non-human soluble hyaluronidases, including non-human animal soluble hyaluronidases, bacterial soluble hyaluronidases and human hyaluronidases, Hyal1, bovine PH20 and ovine PH20, allelic variants thereof and other variants thereof. For example, included among soluble hyaluronan degrading enzymes are any hyaluronan degrading enzymes that have been modified to be soluble. For example, hyaluronan degrading enzymes that contain a GPI anchor can be made soluble by truncation of and removal of all or a portion of the GPI anchor. In one example, the human hyaluronidase PH20, which is normally membrane anchored via a GPI anchor, can be made soluble by truncation of and removal of all or a portion of the GPI anchor at the C-terminus.

Soluble hyaluronan degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan degrading enzyme for use in the compositions, combinations and methods herein is a soluble neutral active hyaluronidase.

Exemplary of a soluble hyaluronidase is PH20 from any species, such as any set forth in any of SEQ ID NOS: 1, 2, 11, 25, 27, 29-32, 63-65 and 101-102, or truncated forms thereof lacking all or a portion of the C-terminal GPI anchor attachment signal site, so long as the hyaluronidase is soluble (secreted upon expression) and retains hyaluronidase activity. Also included among soluble hyaluronidases are allelic variants or other variants of any of SEQ ID NOS: 1, 2, 11, 25, 27, 29-32, 63-65 and 101-102, or truncated forms thereof. Allelic variants and other variants are known to one of skill in the art, and include polypeptides having 60%, 70%, 80%, 90%, 91%, 92%, 93%, 94%, 95%, 96%, 97%, 98%, 99% or more sequence identity to any of SEQ ID NOS: 1, 2, 11, 25, 27, 29-32, 63-65 and 101-102, or truncated forms thereof. Amino acid variants include conservative and non-conservative mutations. It is understood that residues that are important or otherwise required for the activity of a hyaluronidase, such as any described above or known to skill in the art, are generally invariant and cannot be changed. These include, for example, active site residues. Thus, for example, amino acid residues 111, 113 and 176 (corresponding to residues in the mature PH20 polypeptide set forth in SEQ ID NO:2) of a human PH20 polypeptide, or soluble form thereof, are generally invariant and are not altered. Other residues that confer glycosylation and formation of disulfide bonds required for proper folding also can be invariant.

In some instances, the soluble hyaluronan degrading enzyme is normally GPI-anchored (such as, for example, human PH20) and is rendered soluble by truncation at the C-terminus. Such truncation can remove all of the GPI anchor attachment signal sequence, or can remove only some of the GPI anchor attachment signal sequence. The resulting polypeptide, however, is soluble. For example, C-terminal residues set forth in any of SEQ ID NOS: 57-62 can be removed or not present in a soluble human PH20 hyaluronidase. In instances where the soluble hyaluronan degrading enzyme retains a portion of the GPI anchor attachment signal sequence, 1, 2, 3, 4, 5, 6, 7 or more amino acid residues in the GPI-anchor attachment signal sequence can be retained, provided the polypeptide is soluble. Polypeptides containing one or more amino acids of the GPI anchor are termed extended soluble hyaluronan degrading enzymes. One of skill in the art can determine whether a polypeptide is GPI-anchored using methods well known in the art. Such methods include, but are not limited to, using known algorithms to predict the presence and location of the GPI-anchor attachment signal sequence and w-site, and performing solubility analyses before and after digestion with phosphatidylinositol-specific phospholipase C (PI-PLC) or D (PI-PLD).

Extended soluble hyaluronan degrading enzymes can be produced by making C-terminal truncations to any naturally GPI-anchored hyaluronan degrading enzyme such that the resulting polypeptide is soluble and contains one or more amino acid residues from the GPI-anchor attachment signal sequence (see, e.g., U.S. Patent Publication No. US20100143457). Exemplary extended soluble hyaluronan degrading enzymes that are C-terminally truncated but retain a portion of the GPI anchor attachment signal sequence include, but are not limited to, extended soluble PH20 (esPH20) polypeptides of primate origin, such as, for example, human and chimpanzee esPH20 polypeptides. For example, the esPH20 polypeptides can be made by C-terminal truncation of any of the mature or precursor polypeptides set forth in SEQ ID NOS: 1, 2 or 101, or allelic or other variation thereof, including active fragment thereof, wherein the resulting polypeptide is soluble and retains one or more amino acid residues from the GPI-anchor attachment signal sequence. Allelic variants and other variants are known to one of skill in the art, and include polypeptides having 60%, 70%, 80%, 90%, 91%, 92%, 93%, 94%, 95% or more sequence identity to any of SEQ ID NOS: 1 or 2. The esPH20 polypeptides provided herein can be C-terminally truncated by 1, 2, 3, 4, 5, 6, 7, 8, 9, 10 or more amino acids compared to the wild type polypeptide, such as a polypeptide with a sequence set forth in SEQ ID NOS: 1, 2 or 101, provided the resulting esPH20 polypeptide is soluble and retains 1 or more amino acid residues from the GPI-anchor attachment signal sequence.

Typically, for use in the compositions, combinations and methods herein, a soluble human hyaluronan degrading enzyme, such as a soluble human PH20, is used. Although hyaluronan degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Hyaluronan degrading enzymes, including hyaluronidases (e.g., PH20), used in the methods herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

i. Soluble Human PH20

Exemplary of a soluble hyaluronidase is soluble human PH20, Soluble forms of recombinant human PH20 have been produced and can be used in the compositions, combinations and methods described herein. The production of such soluble forms of PH20 is described in U.S. Patent Publication Nos. US20040268425; US20050260186, US20060104968, US20100143457 and International PCT Publication No. WO2009111066. For example, soluble PH20 polypeptides, include C-terminally truncated variant polypeptides that include a sequence of amino acids in SEQ ID NO:1, or have at least 91%, 92%, 93%, 94%, 95%, 95%, 97%, 98% sequence identity to a sequence of amino acids included in SEQ ID NO:1, retain hyaluronidase activity and are soluble. Included among these polypeptides are soluble PH20 polypeptides that completely lack all or a portion of the GPI-anchor attachment signal sequence.

Also included are extended soluble PH20 (esPH20) polypeptides that contain at least one amino acid of the GPI anchor. Thus, instead of having a GPI-anchor covalently attached to the C-terminus of the protein in the ER and being anchored to the extracellular leaflet of the plasma membrane, these polypeptides are secreted and are soluble. C-terminally truncated PH20 polypeptides can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 55, 60 or more amino acids compared to the full length wild type polypeptide, such as a full length wild type polypeptide with a sequence set forth in SEQ ID NOS: 1 or 2, or allelic or species variants or other variants thereof.

For example, soluble forms include, but are not limited to, C-terminal truncated polypeptides of human PH20 set forth in SEQ ID NO:1 having a C-terminal amino acid residue 467, 468, 469, 470, 471, 472, 473, 474, 475, 476, 477, 478, 479, 480, 481, 482 and 483, 484, 485, 486, 487, 488, 489, 490, 491, 492, 493, 494, 495, 496, 497, 498, 499 or 500 of the sequence of amino acids set forth in SEQ ID NO:1, or polypeptides that exhibit at least 85% identity thereto. Soluble forms of human PH20 generally include those that contain amino acids 36-464 set forth in SEQ ID NO:1. For example, when expressed in mammalian cells, the 35 amino acid N-terminal signal sequence is cleaved during processing, and the mature form of the protein is secreted. Thus, the mature soluble polypeptides contain amino acids 36 to 467, 468, 469, 470, 471, 472, 473, 474, 475, 476, 477, 478, 479, 480, 481, 482 and 483 of SEQ ID NO:1. Table 3 provides non-limiting examples of exemplary C-terminally truncated PH20 polypeptides, including C-terminally truncated soluble PH20 polypeptides. In Table 3 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 3 for comparison. In particular, exemplary of soluble hyaluronidases are soluble human PH20 polypeptides that are 442, 443, 444, 445, 446 or 447 amino acids in length, such as set forth in any of SEQ ID NOS: 4-9, or allelic or species variants or other variants thereof.

TABLE 3

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| wildtype | 509 | 1 | 474 | 2 |
| SPAM1-SILF | 500 | 139 | 465 | 183 |
| SPAM-VSIL | 499 | 106 | 464 | 150 |
| SPAM1-IVSI | 498 | 140 | 463 | 184 |
| SPAM1-FIVS | 497 | 107 | 462 | 151 |
| SPAM1-MFIV | 496 | 141 | 461 | 185 |
| SPAM1-TMFI | 495 | 108 | 460 | 152 |
| SPAM1-ATMF | 494 | 142 | 459 | 186 |
| SPAM1-SATM | 493 | 109 | 458 | 153 |
| SPAM1-LSAT | 492 | 143 | 457 | 187 |
| SPAM1-TLSA | 491 | 110 | 456 | 154 |
| SPAM1-PSTL | 489 | 111 | 454 | 155 |
| SPAM1-SPST | 488 | 144 | 453 | 188 |
| SPAM1-STLS | 490 | 112 | 455 | 156 |
| SPAM1-ASPS | 487 | 113 | 452 | 157 |
| SPAM1-NASP | 486 | 145 | 451 | 189 |
| SPAM1-YNAS | 485 | 114 | 450 | 158 |
| SPAM1-FYNA | 484 | 115 | 449 | 159 |
| SPAM1-IFYN | 483 | 46 | 448 | 48 |
| SPAM1-QIFY | 482 | 3 | 447 | 4 |
| SPAM1-PQIF | 481 | 45 | 446 | 5 |
| SPAM1-EPQI | 480 | 44 | 445 | 6 |
| SPAM1-EEPQ | 479 | 43 | 444 | 7 |
| SPAM1-TEEP | 478 | 42 | 443 | 8 |
| SPAM1-ETEE | 477 | 41 | 442 | 9 |
| SPAM1-METE | 476 | 116 | 441 | 160 |
| SPAM1-PMET | 475 | 117 | 440 | 161 |
| SPAM1-PPME | 474 | 118 | 439 | 162 |
| SPAM1-KPPM | 473 | 119 | 438 | 163 |
| SPAM1-LKPP | 472 | 120 | 437 | 164 |
| SPAM1-FLKP | 471 | 121 | 436 | 165 |
| SPAM1-AFLK | 470 | 122 | 435 | 166 |
| SPAM1-DAFL | 469 | 123 | 434 | 167 |
| SPAM1-IDAF | 468 | 124 | 433 | 168 |
| SPAM1-CIDA | 467 | 40 | 432 | 47 |
| SPAM1-VCID | 466 | 125 | 431 | 169 |
| SPAM1-GVCI | 465 | 126 | 430 | 170 |

For example, soluble forms of PH20 include any having a sequence of amino acids set forth in any of SEQ ID NOS: 4-9, 47, 48, 150-170 and 183-189 or a sequence of amino acids that exhibits at least 65%, 70%, 75%, 80%, 85%, 90%, 91%, 92%, 93%, 94%, 95%, 96%, 97%, 98%, 99% sequence identity to any of SEQ ID NOS: 4-9, 47, 48, 150-170 and 183-189. Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g., DG44 CHO cells).

Recombinant soluble forms of human PH20 have been generated and can be used in the compositions, combinations and methods provided herein. The generation of such soluble forms of recombinant human PH20 are described, for example, in U.S. Patent Publication Nos. US20040268425; US 20050260186; US20060104968; US20100143457; and International PCT Pub. No. WO2009111066. Exemplary of such polypeptides are those generated by expression of a nucleic acid molecule encoding amino acids 1-482 (set forth in SEQ ID NO:3). Such an exemplary nucleic acid molecule is set forth in SEQ ID NO:49. Post translational processing removes the 35 amino acid signal sequence, leaving a 447 amino acid soluble recombinant human PH20 (SEQ ID NO:4). As produced in the culture medium there is heterogeneity at the C-terminus such that the product, designated rHuPH20, includes a mixture of species that can include any one or more of SEQ ID NOS: 4-9 in various abundance. Typically, rHuPH20 is produced in cells that facilitate correct N-glycosylation to retain activity, such as CHO cells (e.g., DG44 CHO cells).

Other C-terminal truncated forms of human PH20 include any having a sequence of amino acids set forth in any of SEQ ID NOS: 103-105, 127-138, 147-149, or 171-182, or a sequence of amino acids that exhibits at least 65%, 70%, 75%, 80%, 85%, 90%, 91%, 92%, 93%, 94%, 95%, 96%, 97%, 98% or 99% sequence identity to any of SEQ ID NOS: 103-105, 127-138, 147-149, or 171-182.

d. Glycosylation of Hyaluronan Degrading Enzymes

Glycosylation, including N- and O-linked glycosylation, of some hyaluronan degrading enzymes, including hyaluronidases, can be important for their catalytic activity and stability. While altering the type of glycan modifying a glycoprotein can have dramatic effects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is critical for generating an active enzyme.

N-linked oligosaccharides fall into several major types (oligomannose, complex, hybrid, sulfated), all of which have (Man) 3-GlcNAc-GlcNAc- cores attached via the amide nitrogen of Asn residues that fall within -Asn-Xaa-Thr/Ser-sequences (where Xaa is not Pro). Glycosylation at an -Asn-Xaa-Cys-site has been reported for coagulation protein C. In some instances, a hyaluronan degrading enzyme, such as a hyaluronidase, can contain both N-glycosidic and O-glycosidic linkages. For example, PH20 has O-linked oligosaccharides as well as N-linked oligosaccharides. There are seven potential glycosylation sites at N82, N166, N235, N254, N368, N393, S490 of human PH20 exemplified in SEQ ID NO:1. Amino acid residues N82, N166 and N254 are occupied by complex type glycans whereas amino acid residues N368 and N393 are occupied by high mannose type glycans. Amino acid residue N235 is occupied by approximately 80% high mannose type glycans and 20% complex type glycans. As noted above, O-linked glycosylation at S490 is not required for hyaluronidase activity.

In some examples, the hyaluronan degrading enzymes for use in the compositions, combinations and/or methods provided are glycosylated at one or all of the glycosylation sites. For example, for human PH20, or a soluble form thereof, 2, 3, 4, 5, or 6 of the N-glycosylation sites corresponding to amino acids N82, N166, N235, N254, N368, and N393 of SEQ ID NO:1 are glycosylated. In some examples the hyaluronan degrading enzymes are glycosylated at one or more native glycosylation sites. In other examples, the hyaluronan degrading enzymes are modified at one or more non-native glycosylation sites to confer glycosylation of the polypeptide at one or more additional site. In such examples, attachment of additional sugar moieties can enhance the pharmacokinetic properties of the molecule, such as improved half-life and/or improved activity.

In other examples, the hyaluronan degrading enzymes for use in the compositions, combinations and/or methods provided herein are partially deglycosylated (or N-partially glycosylated polypeptides). For example, partially deglycosylated soluble PH20 polypeptides that retain all or a portion of the hyaluronidase activity of a fully glycosylated hyaluronidase can be used in the compositions, combinations and/or methods provided herein. Exemplary partially deglycosylated hyalurodinases include soluble forms of a partially deglycosylated PH20 polypeptides from any species, such as any set forth in any of SEQ ID NOS: 1, 2, 11, 25, 27, 29-32, 63, 65, and 101-102, or allelic variants, truncated variants, or other variants thereof. Such variants are known to one of skill in the art, and include polypeptides having 60%, 70%, 80%, 90%, 91%, 92%, 93%, 94%, 95% or more sequence identity to any of SEQ ID NOS: 1, 2, 11, 25, 27, 29-32, 63, 65, and 101-102, or truncated forms thereof. The partially deglycosylated hyaluronidases provided herein also include hybrid, fusion and chimeric partially deglycosylated hyaluronidases, and partially deglycosylated hyaluronidase conjugates.

Glycosidases, or glycoside hydrolases, are enzymes that catalyze the hydrolysis of the glycosidic linkage to generate two smaller sugars. The major types of N-glycans in vertebrates include high mannose glycans, hybrid glycans and complex glycans. There are several glycosidases that result in only partial protein deglycosylation, including: EndoF1, which cleaves high mannose and hybrid type glycans; EndoF2, which cleaves biantennary complex type glycans; EndoF3, which cleaves biantennary and more branched complex glycans; and EndoH, which cleaves high mannose and hybrid type glycans. Treatment of a hyaluronan degrading enzyme, such as a soluble hyaluronidase, such as a soluble PH20, with one or all of these glycosidases can result in only partial deglycosylation and, therefore, retention of hyaluronidase activity.

Partially deglycosylated hyaluronan degrading enzymes, such as partially deglycosylated soluble hyaluronidases, can be produced by digestion with one or more glycosidases, generally a glycosidase that does not remove all N-glycans but only partially deglycosylates the protein. For example, treatment of PH20 (e.g., a recombinant PH20 designated rHuPH20) with one or all of the above glycosidases (e.g., EndoF1, EndoF2 and/or EndoF3) results in partial deglycosylation. These partially deglycosylated PH20 polypeptides can exhibit hyaluronidase enzymatic activity that is comparable to the fully glycosylated polypeptides. In contrast, treatment of PH20 with PNGaseF, a glycosidase that cleaves all N-glycans, results in complete removal of all N-glycans and thereby renders PH20 enzymatically inactive. Thus, although all N-linked glycosylation sites (such as, for example, those at amino acids N82, N166, N235, N254, N368, and N393 of human PH20, exemplified in SEQ ID NO:1) can be glycosylated, treatment with one or more glycosidases can render the extent of glycosylation reduced compared to a hyaluronidase that is not digested with one or more glycosidases.

The partially deglycosylated hyaluronan degrading enzymes, including partially deglycosylated soluble PH20 polypeptides, can have 10%, 20%, 30%, 40%, 50%, 60%, 70% or 80% of the level of glycosylation of a fully glycosylated polypeptide. In one example, 1, 2, 3, 4, 5 or 6 of the N-glycosylation sites corresponding to amino acids N82, N166, N235, N254, N368, and N393 of SEQ ID NO:1 are partially deglycosylated, such that they no longer contain high mannose or complex type glycans, but rather contain at least an N-acetylglucosamine moiety. In some examples, 1, 2 or 3 of the N-glycosylation sites corresponding to amino acids N82, N166 and N254 of SEQ ID NO:1 are deglycosylated, that is, they do not contain a sugar moiety. In other examples, 3, 4, 5, or 6 of the N-glycosylation sites corresponding to amino acids N82, N166, N235, N254, N368, and N393 of SEQ ID NO:1 are glycosylated. Glycosylated amino acid residues minimally contain an N-acetylglucosamine moiety. Typically, the partially deglyclosylated hyaluronan degrading enzymes, including partially deglycosylated soluble PH20 polypeptides, exhibit hyaluronidase activity that is 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the fully glycosylated polypeptide.

e. Modified (Polymer-Conjugated) Hyaluronan Degrading Enzymes

In one example, the provided compositions and combinations contain hyaluronan degrading enzymes, in particular soluble hyaluronidases, that have been modified by conjugation to one or more polymeric molecule (polymer), typically to increase the half-life of the hyaluronan degrading enzyme, for example, to promote prolonged/sustained treatment effects in a subject.

Covalent or other stable attachment (conjugation) of polymeric molecules, such as polyethylene glycol (PEGylation moiety (PEG)), to the hyaluronan degrading enzymes, such as hyaluronidases, impart beneficial properties to the resulting hyaluronan degrading enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Hence, in particular examples herein, the hyaluronan degrading enzyme is conjugated to a polymer. Exemplary of polymers are such as polyols (i.e., poly-OH), polyamines (i.e., poly-$NH_2$) and polycarboxyl acids (i.e., poly-COOH), and further heteropolymers i.e., polymers containing one or more different coupling groups e.g., a hydroxyl group and amine groups. Examples of suitable polymeric molecules include polymeric molecules selected from among polyalkylene oxides (PAO), such as polyalkylene glycols (PAG), including polyethylene glycols (PEG), methoxypolyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Numerous reagents for PEGylation have been described in the art. Such reagents include, but are not limited to, N-hydroxysuccinimidyl (NHS) activated PEG, succinimidyl mPEG, mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. No. 5,672,662; U.S. Pat. No. 5,932,462; U.S. Pat. No. 6,495,659; U.S. 6,737,505; U.S. Pat. No. 4,002,531; U.S. Pat. No. 4,179,337; U.S. Pat. No. 5,122,614; U.S. Pat. No. 5,324,844; U.S. Pat. No. 5,446,090; U.S. Pat. No. 5,612,460; U.S. Pat. No. 5,643,575; U.S. Pat. No. 5,766,581; U.S. Pat. No. 5,795,569; U.S. Pat. No. 5,808,096; U.S. Pat. No. 5,900,461; U.S. Pat. No. 5,919,455; U.S. Pat. No. 5,985,263; U.S. Pat. No. 5,990,237; U.S. Pat. No. 6,113,906; U.S. Pat. No. 6,214,966; U.S. Pat. No. 6,258,351; U.S. Pat. No. 6,340,742; U.S. Pat. No. 6,413,507; U.S. 6,420,339; U.S. Pat. No. 6,437,025; U.S. Pat. No. 6,448,369; U.S. Pat. No. 6,461,802; U.S. Pat. No. 6,828,401; U.S. Pat. No. 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; WO05000360; U.S. 2005/0114037; U.S. 2005/0171328; U.S. 2005/0209416; EP 1064951; EP 0822199; WO 01076640; WO 0002017; WO 0249673; WO 94/28024; and WO 01/87925).

In particular, the polymer is a polyethylene glycol (PEG). Suitable polymeric molecules for attachment to the hyaluronan degrading enzymes, including hyaluronidases, include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g., Roberts et al., *Advanced Drug Delivery Review* (2002) 54: 459-476; Harris and Zalipsky, S (eds.) "Poly(ethylene glycol), Chemistry and Biological Applications" ACS Symposium Series 680, 1997; Mehvar et al., *J. Pharm. Pharmaceut. Sci.*, 3(1):125-136, 2000; Harris, (2003) *Nature Reviews Drug Discovery* 2:214-221; and Tsubery, (2004) *J Biol. Chem.* 279(37):38118-24). The polymeric molecule can be of a molecular weight typically ranging from about 3 kDa to about 60 kDa. In some embodiments the polymeric molecule that is conjugated to a protein, such as rHuPH20, has a molecular weight of 5, 10, 15, 20, 25, 30, 35, 40, 45, 50, 55, 60 or more than 60 kDa.

Covalent attachment of the PEG to the drug (known as "PEGylation") can be accomplished by known chemical synthesis techniques. For example, the PEGylation of protein can be accomplished by reacting NHS-activated PEG with the protein under suitable reaction conditions. Various methods of modifying polypeptides by covalently attaching (conjugating) a PEG or PEG derivative (i.e., "PEGylation") are known in the art (see e.g., U.S. 2006/0104968; U.S. Pat. No. 5,672,662; U.S. Pat. No. 6,737,505; and U.S. 2004/0235734). Methods for PEGylation of hyaluronan degrading polypeptides, including, for example, animal-derived hyaluronidases and bacterial hyaluronan degrading enzymes, are known to one of skill in the art. See, for example, European Patent No. EP 0400472, which describes the PEGylation of bovine testes hyaluronidase and chondroitin ABC lyase. Also, U.S. Patent Publication No. 20060104968 describes PEGylation of a human hyaluronidase derived from human PH20. For example, the PEGylated hyaluronan-degrading enzyme generally contains at least 3 PEG moieties per molecule. For example, the hyaluronan-degrading enzyme can have a PEG to protein molar ratio between 5:1 and 9:1, for example, 7:1.

Typically, to make the PEGylated hyaluronan degrading enzymes provided herein, including the PEGylated hyaluronidases, PEG moieties are conjugated, via covalent attachment, to the polypeptides. Techniques for PEGylation include, but are not limited to, specialized linkers and coupling chemistries (see e.g., Roberts et al., *Adv. Drug Deliv. Rev.* 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.*, 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

As an exemplary illustrative method for making PEGylated hyaluronan degrading enzymes, such as PEGylated hyaluronidases, PEG aldehydes, succinimides and carbonates have each been applied to conjugate PEG moieties, typically succinimidyl PEGs. Exemplary succinimidyl monoPEG (mPEG) reagents including mPEG-Succinimidyl Propionates (mPEG-SPA), mPEG-Succinimidyl Butanoates (mPEG-SBA), and (for attaching "branched" PEGs) mPEG2-N-Hydroxylsuccinimide. These PEGylated succinimidyl esters contain different length carbon backbones between the PEG group and the activated cross-linker, and either a single or branched PEG group. These differences can be used, for example, to provide for different reaction kinetics and to potentially restrict sites available for PEG attachment to rHuPH20 during the conjugation process. PEGs can used to generate hyaluronan-degrading enzymes reproducibly containing molecules having, on the average, between about three to six or three to six PEG molecules per hyaluronidase. Such PEGylated rHuPH20 compositions can be readily purified to yield compositions having specific activities of approximately 25,000 or 30,000 Unit/mg protein hyaluronidase activity, and being substantially free of non-PEGylated rHuPH20 (less than 5% non-PEGylated).

In one example, the PEGylation includes conjugation of mPEG-SBA, for example, mPEG-SBA-30K (having a molecular weight of about 30 kDa) or another succinimidyl esters of PEG butanoic acid derivative, to a soluble hyaluronidase. Succinimidyl esters of PEG butanoic acid derivatives, such as mPEG-SBA-30K readily couple to amino groups of proteins. For example, covalent conjugation of m-PEG-SBA-30K and rHuPH20 (which is approximately 60 kDa in size) provides stable amide bonds between rHuPH20 and mPEG, as shown in Scheme 1, below.

Scheme 1

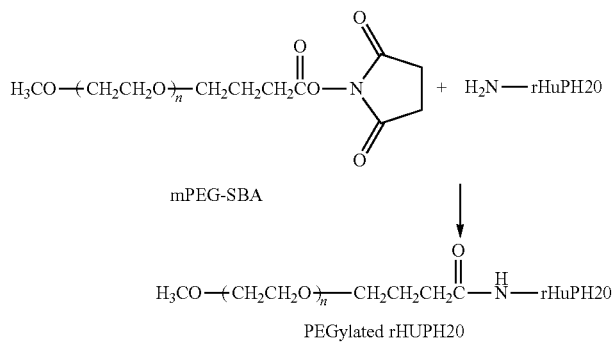

PEGylated rHUPH20

Typically, the mPEG-SBA-30K or other PEG is added to the hyaluronan degrading enzyme, in some instances a hyaluronidase, at a PEG:polypeptide molar ratio of 10:1 in a suitable buffer, e.g., 130 mM NaCl/10 mM HEPES at pH 6.8 or 70 mM phosphate buffer, pH 7, followed by sterilization, e.g., sterile filtration, and continued conjugation, for example, with stirring, overnight at 4° C. in a cold room. In one example, the conjugated PEG-hyaluronan degrading enzyme is concentrated and buffer-exchanged.

Other methods of coupling succinimidyl esters of PEG butanoic acid derivatives, such as mPEG-SBA-30K are known in the art (see e.g., U.S. Pat. No. 5,672,662; U.S. Pat. No. 6,737,505; and U.S. 2004/0235734). For example, a polypeptide, such as a hyaluronan degrading enzyme (e.g., a hyaluronidase), can be coupled to an NHS activated PEG derivative by reaction in a borate buffer (0.1 M, pH 8.0) for one hour at 4° C. The resulting PEGylated protein can be purified by ultrafiltration. Alternatively, PEGylation of a bovine alkaline phosphatase can be accomplished by mixing the phosphatase with mPEG-SBA in a buffer containing 0.2 M sodium phosphate and 0.5 M NaCl (pH 7.5) at 4° C. for 30 minutes. Unreacted PEG can be removed by ultrafiltration. Another method reacts polypeptide with mPEG-SBA in deionized water to which triethylamine is added to raise the pH to 7.2-9. The resulting mixture is stirred at room temperature for several hours to complete the PEGylation.

G. MONITORING THERAPIES

Provided herein are methods of monitoring therapy with a hypoxia-activated agent or an anti-hyaluronan agent to determine if the treatment is working. Such assays can be performed on a subject, such as a human subject, known or suspected of having a hyperproliferative disease or condition (e.g., cancer) or other hypoxia-related or hyaluronan-associated disease or condition and that have been treated with agents as described herein. The subject can be any subject receiving therapy with an agent described herein (e.g., a hypoxia-activated agent or anti-hyaluronan agent). In particular, the subject typically is one that has been diagnosed with a tumor or cancer, and is being treated. For example, the method provided herein is typically practiced on a patient that has been diagnosed with cancer, a precancerous condition or another form of abnormal cell growth, and thus is being treated with an agent herein. The cancer can be a lung cancer (e.g., non-small cell lung cancer (NSCLC)), pancreatic cancer, head and neck cancer, gastric cancer, breast cancer, colon cancer, ovarian cancer, or any of a variety of other cancers described herein below. Hence, the methods provided herein permit early determinations regarding the effectiveness of therapy, which can aid decisions regarding altering, adjusting or discontinuing the therapy.

If monitoring methods indicate that the therapeutic method is effective, a decision can be made to maintain the current course of therapy, which can include further administrations of therapeutic agent, or a decision can be made that no further administrations are required. If monitoring methods indicate that a therapeutic method is ineffective, the monitoring results can indicate whether or not a course of treatment should be discontinued, or changed (e.g., when a therapeutic method has no effect), or increased in frequency or amount (e.g., slightly affected by the therapeutic treatment). For example, the dosage or dosage regime can be altered by increasing or decreasing the dosage of administered agent and/or increasing or decreasing the frequency of dosage of the administered agents. Additional combination therapies can be employed.

The time between initiation of agent therapy as described herein and measuring or assessing the level or presence of a marker or other parameter indicative of response for the purpose of monitoring therapy can be empirically determined by the skilled artisan. The particular duration after initiation of therapy can vary depending on the particular agent used for treatment, the marker or parameter assessed as an indicator of response to therapy, the particular subject being treated, the severity or extent of the disease or condition and other similar factors. Typically, a subject is monitored within or about or at least 12 hours to 4 weeks or more, such as 1 day to 2 weeks or 1 day to 1 week, and generally within 1 day, 2 days, 3 days, 4 days, 5 days, 6 days, 7 days, 8 days, 9 days, 10 days, 11 days, 12 days, 13 days, 14 days or more after initiation of treatment with an agent as described herein. Monitoring also can occur periodically or intermittently as desired or prescribed by a practicing physician. For example, subjects can be monitored daily, weekly or monthly. In some cases, subjects are monitored before or after each dosing or before or after each cycle of administration.

Exemplary markers for use in assessing the efficacy of treatment are markers that target or are indicators of the extent of hypoxia or hyaluronan levels in a subject as described herein. Various combinations of the above markers can be utilized to monitor treatment with agents described herein. In particular, hypoxia-detecting agents are contemplated herein for monitoring treatment with an anti-hyaluronan agent. On the other hand, hyaluronan-associated markers can be employed for monitoring treatment with a hypoxia-activated agent.

1. Hypoxia-Detecting Agents

The reduction in hypoxia that occurs upon treatment with an anti-hyaluronan agent (e.g., a hyaluronan-degrading enzyme or modified form thereof, such as PH20) as found herein can be used as a therapeutic indicator that treatment with an anti-hyaluronan agent is effective. Thus, hypoxia-detecting agents can be used to monitor treatments with an anti-hyaluronan agent (e.g a hyaluronan-degrading enzyme or modified form thereof, such as PEGPH20).

For example, methods provided herein of determining if a subject having a hyaluronan-associated disease or condition, such as a hyperproliferative disease or disorder (e.g., tumor or cancer), is responding to treatment with an anti-hyaluronan agent includes after treatment with an anti-hyaluronan agent (e.g., a hyaluronan-degrading enzyme, such as PEGPH20) determining the hypoxic fraction or hypoxic level in a sample from the subject. Optionally in aspects of the methods herein, the hypoxia-detecting agent is administered or introduced to the subject prior to determining the hypoxic fraction or level in a sample from the subject. In other cases, the hypoxic fraction or hypoxic level in a sample from a subject can be determined using a marker of hypoxia that has not been previously introduced to the subject but that is altered in a manner that is indicative of hypoxia. The samples can be a body fluid or tissue sample. In particular examples, the sample is a tumor sample. The method of determining the hypoxic fraction or level in a sample can be by invasive or non-invasive methods. In particular examples, the hypoxia-detecting agent is one that is detected by non-invasive techniques. For example, the agent is one that permits detection of hypoxic tissues or cells, such as tumors, by imaging techniques, or is one that can otherwise be detected in a body fluid (serum or blood) as an indicator of hypoxic levels in tissues or cells (e.g., tumors). In other examples, immunohistochemistry or other techniques can be used of tumor biopsies.

In particular examples, nitroimidazoles (e.g., 2-nitroimidazole compounds) can be used as a bioreducible marker of hypoxia, and hence are hypoxia-detecting agents. Nitroimidazoles can enter cells by passive diffusion and undergo a single electron reduction to form a reactive species, but when an abundance of oxygen is present can result in immediate reoxidation. Under hypoxic conditions, however, molecular trapping occurs whereby the nitro group undergoes electron reduction to form reactive radicals, which is further reduced to form covalent bonds with intracellular macromolecules. In particular, such markers are activated between 10 and 20 mm Hg, and accumulation or trapping falls below an oxygen partial pressure of 25 mm Hg or lower. Molecular oxygen competes with reducing equivalents in a manner such that nitroimidazole binding is effectively inhibited at oxygen concentrations above 14 micromolar. Also, dead cells (necrosis) are not able to metabolize these compounds such that the markers preferentially accumulate in viable cells and tissues. By virtue of their accumulation and trapping in tissues and cells (e.g., tumors) as a result of the hypoxic condition, they can be detected. Thus, methods using nitroimidazoles reliably identifies viable hypoxic cells specifically (necrotic cells cannot metabolize the compound).

The nitroimidazole compounds are typically hydrophilic and exhibit high lipophilicity to diffuse across cell membranes. Such hypoxia-activated agents that can detect hypoxic cells in vivo include, but are not limited to, pimonidazole, 2-(2-nitroimidazol-1H-yl)-N-(3-fluoropropyl)acetamide (EF1), EF3, 2-(2-nitro-(1)H-imidazol-1-yl)-N-(2,2,3,3,3-pentafluoropropyl)-acetamide (EF5), NITP and CC1-103F, fluoromisonidazole (FMISO), fluoroerythronitroimidazole (FETNIM), fluoroetanidazole (FETA), fluoroazomycin arabinoside, copper(II)diacetyl-di($N^4$-methylthiosemicarbazone (Cu-ATSM), fluoro-2-(4-((2-nitro-1H)-imidazol-1-1-yl)methyl)-1H-1,2,3,-triazol-1-yl)propan-1-ol (HX4) or iodoazomycin galactoside (IAZGP). Such hypoxia markers can be detected with antibodies and the hypoxia level or hypoxic fraction determined by immunoassay or flow cytometry. In other examples, image analysis of microscopic sections can be performed. For example, the exemplary hypoxia marker EF5 can be detected by uptake of a radiolabeled drug or by flow cytometry using antibodies specific for drug adducts (e.g., Koch et al. (2008) Radiat Res, 169:677-88).

Typically hypoxia-detecting agents, including nitroimidazoles, for use in the methods herein include bioreducible tracers that can be detected using single photon emission computed tomography (SPECT) or positron-emission tomography (PET). Such imaging techniques require introduction of a radionuclide-labeled molecule into a subject. The radionuclide labeled molecule can be introduced orally or systemically (e.g., intravenously). Images are created based on emission of the radionuclide. For PET imaging, the isotopes are typically administered to a patient by injection of probe molecules that contain a positron-emitting isotope, such as 11-carbon ($^{11}C$), 13-nitrogen ($^{13}N$), 15-oxygen ($^{15}O$), and 18-fluorine ($^{18}F$), covalently attached to a molecule that is readily metabolized or localized in cells or that chemically binds to receptor sites within cells. Positron emitting isotope of copper [$^{60}Cu$], [$^{61}Cu$], [$^{62}Cu$] or [$^{64}Cu$] also can be employed. For SPECT techniques, isotopes that decay be electron capture and/or gamma emission can be used, including 23-iodine ($^{123}I$) and the long-lived metastable nuclide 99m-technetium ($^{99m}Tc$).

Exemplary of hypoxia-activated agents, include, for example, [$^{18}F$]-fluoromisonidazole ([$^{18}F$]-F-MISO; Rasey, J. S., et al. (2000) Radiat. Res., 153: 84-92; Bentzen, L. et al. (2000) Acta. Oncol., 39:629-637), [$^{18}F$]F-EF1 (Hustinx, R., et al. (1999) J. Nucl. Med., 4:99 P (abstract 401)), [$^{18}F$]F-nitroimidazol-1H-yl-N-[$^{18}F$]-trifluoropropyl acetamide ([$^{18}F$]-EF3; Dubois et al. (2009) Eur J Nucl Med Mol Imaging, 36:209-218), [$^{18}F$]-EF5 (Komar et al. (2008) J Nucl Med, 49:1944-51), [$^{18}F$]-fluoroerythronitroimidazole ([$^{18}F$]-FETNIM; Chao, K. S., et al. (2001) Int. J. Radiat. Oncol. Biol. Phys., 49:1171-1182; Yang, D. J., et al. (1995) Radiology 194:795-800; Gronroos, T., et al. (2001) J. Nucl. Med., 42: p. 1397-1404), [$^{18}F$]FRP-170 (Ishikawa, Y., et al. (2005) Kaku Igaku., 42:1-10), copper(II)diacetyl-di(N4-methylthiosemicarbazone (Cu-ATSM) ([$^{62}Cu$]-ATSM, Fujibayashi, Y. et al. (1997) J. Nucl. Med., 38:1155-1160; [$^{60}Cu$]-ATSM, Dehdashti et al. (2003) Eur J Nucl Med Mol Imaging, 30:844-850), [$^{18}F$]-fluoroazomycin arabinoside ([$^{18}F$]FAZA; Lucignani (2008) Eur J Nucl Med Mol Imaging, 35:838-842; Serganova et al. (2006) Clin Cancer Res, 12:5260-5264), 3-[$^{18}F$]fluoro-2-(4((2-nitro-1H-imidazol-1-yl)methyl)-1H-1,2,3,-triazol-1-yl)-propan-1-ol ([$^{18}F$]HX4; Dubois et al. (2011) PNAS 108:14620-14625; Walsh et al. (2010) Chimia (Aarau), 64:29-33; U.S. Pat. No. 7,977,361), [$^{68}Ga$]-1,4,7-Triazacyclononane-1,4,7-triacetic acid-2-nitroimidazole-N-ethylamine ($^{68}Ga$-NOTA-NI) and [$^{68}Ga$]-isothiocyanatobenzyl-1,4,7-triazacyclononane-1,4,7-triacetic acid-2-nitroimidazole-N-ethylamine ($^{68}Ga$-SCN-NOTA-NI) or $^{124}I$-iodoazomycin arabinoside.

In methods using nitroimidazole hypoxia markers, the hypoxia-specific tracer is typically introduced systemically (e.g., intravenously) in an amount that is 100 to 500 MBq (e.g., 200 to 400 MBq) or 0.1 µg to 15 µg (e.g., 0.2 µg to 10

μg). For example, dosages can be 1.0 MBq/kg to 7.0 MBq/kg, and generally 2.0 MBq/kg to 4.0 MBq/kg (assuming 70 kg subject). Imaging can be performed within 30 minutes to 6 hours after tracer administration, and typically within 1 to 3 hours, such as 90 to 120 minutes after tracer administration. PET and SPECT imaging methods are well known to those of skill in the art. The resulting tracer distribution can be expressed as a ratio of tumor to background signal (T/B ratio) calculated as the mean activity in the tumor region divided by the mean activity in the background region (e.g., muscle). In calculating the T/B ratio, the static image data can be normalized to the radionuclide concentration in the blood from a venous blood sample. A T/B ratio that is typically greater than 1.4 is characteristic for hypoxic tissue areas.

Other hypoxic markers also are suitable for use in accordance with the methods herein including, but not limited to, GLUT-1, HIF-1α, CA-IX, LDH-A, osteopontin, VEGF, and microRNA markers, including but not limited to miPv-210. Each of these proteins or RNAs is up-regulated in hypoxia, and they can be detected in a sample (e.g., tissue or body fluid). For example, the markers can be detected by tumor biopsy. In other cases, certain of these markers (e.g., CA-IX LDH-A, osteopontin, VEGF, and microRNA markers, including but not limited to miR-210) can be detectable in the blood, serum, or plasma of a patient, allowing a simple blood test, instead of a tumor biopsy, to be used assess hypoxia.

MRI or EPRI can also be used to detect hypoxia (i.e., to measure the hypoxic fraction of a tumor or otherwise to provide a measure of hypoxia in the cancer). In particular, dynamic contrast-enhanced MRI (DCE-MRI), blood oxygen level-dependent MRI (BOLD-MRI), or diffusion-weighted (DW MRI) can be used to identify hypoxic cancers and extent of hypoxic cancers, and thus monitor whether the hypoxic condition is reduced and the anti-hyaluronan agent is working.

In another example, Hypoxyprobe®-1 can be administered to a subject, and detected by immunohistochemistry or other similar methods from a tumor biopsy. Hypoxyprobe®-1 (pimonidazole hydrochloride, marketed by Hypoxyprobe, Inc.) when administered, either IV or orally, is distributed to all tissues in the body including the brain but only forms adducts with proteins in those cells that have an oxygen concentration less than 14 micromolar (equivalent to a $pO_2$ of 10 mm Hg at 37 degrees Celsius). Hypoxyprobe-1 MAb1 is a mouse IgG1 monoclonal antibody that detects protein adducts of Hypoxyprobe-1 in hypoxic cells. Chromogenic or fluorescent secondary antibody reagents can then be used to reveal where Hypoxyprobe-1 adducts have formed in the hypoxic tissue.

In other examples, a polarographic needle electrode probe can be used to directly measure cell or tissue (e.g., tumor) $pO_2$. In such methods, which can be invasive, a needle electrode (5-300 microns) is steeped through the tissue. Oxylite® also is a technique to directly measure $pO_2$. Further, EPR spectroscopy also is a direct measure of absolute oxygen concentration as determined by changes in EPR spectral linewidth caused by the interaction between paramagnetic molecular oxygen and the paramagnetic sensor.

In any of the above examples, following treatment with an anti-hyaluronan agent, a sample from a subject can be assessed for the level or extent of hypoxia in a cell or tissue (e.g., tumor) to determine if the anti-hyaluronan agent is working. The level or extent of hypoxia in the sample can be compared to a control sample to assess difference (e.g., reduction or decrease) in the level or extent of hypoxia. The control sample can be a sample from a healthy subject, a sample from the subject prior to treatment with the anti-hyaluronan agent (e.g., hyaluronan-degrading enzyme or modified form thereof, such as PEGPH20), or a sample from the subject taken at an earlier time after treatment with the anti-hyaluronan agent (e.g., hyaluronan-degrading enzyme or modified form thereof, such as PEGPH20). For example, the reduction can be monitored over time, and the control sample can be sample taken just prior to the last dosing or dosage cycle. Typically the sample is an analogous sample (e.g., same tissue or tumor source). Hence, these methods can be used to identify subjects that are responding to therapy with an anti-hyaluronan agent because the hypoxic fraction of the tumors in such subjects should decrease over time, as the anti-hyaluronan agent degrades cell-associated hyaluronan in the cells in the hypoxic fraction. In such examples, a reduction in hypoxia level or hypoxic fraction compared to control is an indicator that the anti-hyaluronan agent treatment is working.

The reduction in hypoxia levels can be at least 1%, at least 2%, at least 5%, at least 7.5%, at least 10%, at least 15%, at least 20%, at least 25%, at least 30%, at least 40%, at least 50%, at least 75%, or more reduced, compared to control hypoxia levels (e.g., hypoxia levels prior to treatment with the anti-hyaluronan agent or hypoxia levels). In one example, the reduction in hypoxia levels is reflected as the tumor to background (T/B) ratio of the hypoxia-detecting agent or marker, and treatment is working or is efficacious if the T/B ratio is decreased or reduced at least 1%, at least 2%, at least 5%, at least 7.5%, at least 10%, at least 15%, at least 20%, at least 25%, at least 30%, at least 40%, at least 50%, at least 75%, or more reduced, compared to control hypoxia levels (e.g., hypoxia levels prior to treatment with the anti-hyaluronan agent or hypoxia levels). In other examples, the reduction in hypoxia levels is reflected by an increase in the oxygen partial pressure (e.g. in a tissue or cell of the treated subject, such as a tumor), and treatment is working or is efficacious if the oxygen partial pressure is at least 1%, at least 2%, at least 5%, at least 7.5%, at least 10%, at least 15%, at least 20%, at least 25%, at least 30%, at least 40%, at least 50%, at least 75%, at least 80%, at least 90%, or more increased, compared to the oxygen partial pressure levels in a tissue or cell of a control (e.g., hypoxia prior to treatment with an anti-hyaluronan agent).

In some examples, the reduction in hypoxia can be determined as a decrease in the hypoxic fraction of a tissue or cell (e.g., a tumor). The hypoxic fraction is the percent or portion of tissue with $pO_2<10$ mmHg, or percent of pixels in a $pO_2$ image with $pO_2<10$ mmHg). For example, hypoxia is reduced and a subject is responding to treatment with an anti-hyaluronan agent (e.g., a hyaluronan-degrading enzyme or modified form thereof, such as PEGPH20) if the hypoxic fraction of a tissue or cell (e.g., tumor) is decreased by at least 1%, at least 2%, at least 5%, at least 7.5%, at least 10%, at least 15%, at least 20%, at least 25%, at least 30%, at least 40%, at least 50%, at least 76%, at least 80%, at least 90%, or more decreased, compared to the hypoxic fraction in control cells or tissues, such as tumors (e.g., hypoxic fraction prior to treatment with an anti-hyaluronan agent). In one embodiment, the increase in hypoxic fraction is a transient increase.

2. Hyaluronan-Associated Markers

As described herein, the degree of the level or amount of hyaluronan, such as on tumors, is an indicator of the hypoxic state of a tissue or cell. Accordingly, the extent and level of HA phenotype is a biomarker that is associated with and correlates to efficacy and activity of a hypoxia-activated agent. Subjects treated with hypoxia-activated agents with the goal of reducing hypoxia in a cell or tissue can be monitored for the efficacy of the treatment by assessing hyaluronan levels in a sample or tissue, such as a tissue (e.g., tumor biopsy) or bodily fluid (e.g., plasma). For example, for cancer patients with tumors such as advanced solid tumors, reduced tumor- and stroma-associated is a biomarker of activity of an administered hyaluronan-degrading enzyme. An HABP binding assay to detect HA present in tissue (e.g., tumor biopsy) or bodily fluids (e.g., plasma) as described elsewhere herein can be performed to evaluate and monitor the therapeutic effect of an anti-hyaluronan (e.g., hyaluronan-degrading enzyme).

3. Other Monitoring Methods

The methods provided herein can further include one or more steps of monitoring the subject by assessing, directly or indirectly, hyaluronan (HA) in a sample. For example, as described elsewhere herein, a subject can be monitored by directly assessing the level or amount of a hyaluronan-associated marker over time and during the course of a treatment. Other clinical measures or biomarkers that correlate to the level or amount of hyaluronan in a sample include, but are not limited to, reduced tumor metabolic activity, increased apparent diffusion and enhanced tumor perfusion and/or increase in HA catabolites. Additional assays to measure such biomarkers can include, but are not limited to, measurements of hyaluronan catabolites in blood or urine, measurements of hyaluronidase activity in plasma, or measurements of interstitial fluid pressure, vascular volume or water content in tumors. It is within the level of one skilled in the art to perform such assays.

In addition, subjects can be monitored by monitoring the tumor, the general health of the subject and/or course of disease in the subject. Any of a variety of monitoring steps can be included in the methods provided herein, including, but not limited to, monitoring tumor size, monitoring anti-(tumor antigen) antibody titer, monitoring the presence and/or size of metastases, monitoring the subject's lymph nodes, and monitoring the subject's weight or other health indicators including blood or urine markers.

The purpose of the monitoring can be for assessing the health state of the subject or the progress of therapeutic treatment of the subject, or can be for determining whether or not further administration of the same or a different hypoxia-activated agent, anti-hyaluronan agent or other treatment is warranted, or for determining when or whether or not to administer a further agent or treatment.

a. Assays to Assess Enzyme Activity

The activity of a hyaluronan degrading enzyme can be assessed using methods well known in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Hyaluronidase Reference Standard (USP) or National Formulary (NF) Standard Hyaluronidase solution can be used in an assay to ascertain the activity, in units, of any hyaluronidase. In one example, activity is measured using a microturbidity assay. This is based on the formation of an insoluble precipitate when hyaluronic acid binds with serum albumin. The activity is measured by incubating hyaluronidase or a sample containing hyaluronidase, for example blood or plasma, with sodium hyaluronate (hyaluronic acid) for a set period of time (e.g., 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity.

In another example, hyaluronidase activity is measured using a microtiter assay in which residual biotinylated hyaluronic acid is measured following incubation with hyaluronidase or a sample containing hyaluronidase, for example, blood or plasma (see e.g., Frost and Stern (1997) Anal. Biochem. 251:263-269, U.S. Patent Publication No. 20050260186). The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity. Other assays to measure hyaluronidage activity also are known in the art and can be used in the methods herein (see e.g., Delpech et al., (1995) Anal. Biochem. 229:35-41; Takahashi et al., (2003) Anal. Biochem. 322:257-263).

b. Measurement of HA Catabolites

In another example, blood and urine can be collected at different time points throughout patient treatment and assayed for catabolites of hyaluronan. The presence of catabolites is indicative of the degradation of hyaluronan and is thus a measure of the activity of hyaluronidase. Plasma enzyme also can be assessed and measured over time following administration. For example, HA catabolites, which are HA-disaccharide breakdown products, can be assessed using high-performance liquid chromatography (HPLC) to separate and measure saccharide peak areas. The Example 15 exemplifies this assay.

c. Tumor Metabolic Activity

A reduction in tumor metabolic activity is associated with anti-hyaluronan agent (e.g., hyaluronan-degrading enzyme) activity. Tumor metabolic activity can be assessed using standard procedures known in the art. For example, [$^{18}$F]-fluorodeoxyglucose positron emission tomography (FDG-PET) can be used. PET is a non-invasive diagnostic that provides images and quantitative parameters of perfusion, cell viability, proliferation and/or metabolic activity of tissues. The images result from the use of different biological substances (e.g., sugars, amino acids, metabolic precursors, hormones) labelled with positron emitting radioisotopes. For example, FDG is an analogue of glucose and is taken up by living cells via the first stages of normal glucose pathway. In cancers, increased glycolytic activity exists resulting in trapping of FDG in the cancer cell. A decrease in FDG trapping correlates with a decreased tumor metabolic activity and anti-tumorigenic activity. Guidelines for PET imaging are known to one of skill in the art and should be followed by any treating physician or technician.

d. Increased Apparent Diffusion and Enhanced Tumor Perfusion

The diffusion of water in tissues is also an indirect marker of hyaluronan levels or amounts, and can be assessed. As discussed elsewhere herein, tissues that accumulate hyaluronan generally have a higher interstitial fluid pressure than normal tissue due to the concomitant accumulation of water. Thus, tissues that accumulate HA, such as tumors, have high interstitial fluid pressure, which can be measured by various methods known in the art. For example, diffusion MRI, such as ADC MRI or DCE MRI, can be used. Diffusion of water can be assessed by these procedures, and is directly correlated to presence of hyaluronan-rich tissues, such as solid tumors (see e.g., Chenevert et al. (1997) *Clinical Cancer Research,*

3:1457-1466). For example, tumors that accumulate hyaluronan have a distinguishable increase in ADC MRI or DCE MRI because of increased perfusion. Such assays can be performed in the presence and absence of a hyaluronan-degrading enzyme, and results compared. Methods of measuring diffusion are a useful measure of assessing cellular changes following such therapies.

e. Tumor Size and Volume

For example, the tumor and/or metastasis size and location can be monitored. Tumor and or metastasis size can be monitored by any of a variety of methods known in the art, including external assessment methods or tomographic or magnetic imaging methods, such as the detection methods described herein. Monitoring size over several time points can provide information regarding the efficacy of the therapeutic methods provided herein. In addition, monitoring the increase or decrease in size of a tumor or metastasis, and can also provide information regarding the presence (i.e., detection and/or diagnosis) of additional tumors and/or metastases in the subject. Monitoring tumor size over several time points can provide information regarding the development of a neoplastic disease in a subject, including the efficacy of treatments of a neoplastic disease in a subject, such as the treatment provided herein.

In particular examples, reductions in tumor size and/or volume indicate that therapy is working. Tumor size and volume can be monitored based on techniques known to one of skill in the art. For example, tumor size and volume can be monitored by radiography, ultrasound imaging, necropsy, by use of calipers, by microCT or by $^{18}$F-FDG-PET. Tumor size also can be assessed visually. In particular examples, tumor size (diameter) is measured directly using calipers.

In other examples, tumor volume can be measured using an average of measurements of tumor diameter (D) obtained by caliper or ultrasound assessments. For example, tumor volume can be determined using VisualSonics Vevo 770 high-resolution ultrasound or other similar ultrasound. The volume can be determined from the formula $V=D^3 \times \pi/6$ (for diameter measured using calipers) or $V=D^2 \times d \times \pi/6$ (for diameter measured using ultrasound where d is the depth or thickness). For example, caliper measurements can be made of the tumor length (l) and width (w) and tumor volume calculated as length×width$^2$×0.52. In another example, microCT scans can be used to measure tumor volume (see e.g., Huang et al. (2009) *PNAS*, 106:3426-3430). As an example, mice can be injected with Optiray Pharmacy ioversol injection 74% contrast medium (e.g., 741 mg of ioversol/mL), mice anesthetized, and CT scanning done using a MicroCat 1A scanner or other similar scanner (e.g., IMTek) (40 kV, 600 μA, 196 rotation steps, total angle or rotation=196). The images can be reconstructed using software (e.g., RVA3 software program; ImTek). Tumor volumes can be determined by using available software (e.g., Amira 3.1 software; Mercury Computer Systems). Tumor volume or size also can be determined based on size or weight of a tumor.

The percent of tumor growth inhibition can be calculated based on the volume using the equation: % TGI= $[1-(T_n-T_0) \div (C_n-C_0)] \times 100\%$, where "$T_n$" is the average tumor volume for the treatment group at day "n" after the final dose of hyaluronan-degrading enzyme; "$T_0$" is the average tumor volume in that treatment group at day 0, before treatment; "$C_n$" is the average tumor volume for the corresponding control group at day "n"; and "$C_0$" is the average tumor volume in the control group at day 0, before treatment. Statistical analysis of tumor volumes can be determined.

f. Health of Subject

Parameters indicative of the health of a subject also can be monitored. Monitoring the health of a subject can be used to determine the efficacy of the therapeutic method, as is known in the art. Any of a variety of health diagnostic methods for monitoring disease such as neoplastic disease or other disease can be monitored, as is known in the art. For example, the weight, blood pressure, pulse, breathing, color, temperature or other observable state of a subject can indicate the health of a subject. In addition, the presence or absence or level of one or more components in a sample from a subject can indicate the health of a subject. Typical samples can include blood and urine samples, where the presence or absence or level of one or more components can be determined by performing, for example, a blood panel or a urine panel diagnostic test. Exemplary components indicative of a subject's health include, but are not limited to, white blood cell count, hematocrit, or reactive protein concentration.

H. METHODS OF PRODUCING NUCLEIC ACIDS AND ENCODED POLYPEPTIDES

Polypeptides for use in the methods herein, including a hyaluronan degrading enzyme, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a hyaluronidase, such as from a cell or tissue source. Modified or variant soluble hyaluronidases, can be engineered from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g., blood, serum, saliva), samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene. For example, enzymes can be linked to PEG moieties.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:54) or Flag Tag (DYKDDDDK; SEQ ID NO:55).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein. The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the desired proteins, such as any hyaluronan degrading enzyme polypeptide described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes the hyaluronan degrading enzyme polypeptide, in some examples a soluble hyaluronidase polypeptide, coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein coding sequence. These include but are not limited to mammalian cell systems infected with virus (e.g., vaccinia virus, adenovirus and other viruses); insect cell systems infected with virus (e.g., baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, Nature 290:304-310 (1981)), the promoter contained in the 3' long terminal repeat of Rous sarcoma virus (Yamamoto et al. Cell 22:787-797 (1980)), the herpes thymidine kinase promoter (Wagner et al., Proc. Natl. Acad. Sci. USA 78:1441-1445 (1981)), the regulatory sequences of the metallothionein gene (Brinster et al., Nature 296:39-42 (1982)); prokaryotic expression vectors such as the β-lactamase promoter (Jay et al., (1981) Proc. Natl. Acad. Sci. USA 78:5543) or the tac promoter (DeBoer et al., Proc. Natl. Acad. Sci. USA 80:21-25 (1983); see also "Useful Proteins from Recombinant Bacteria": in Scientific American 242:79-94 (1980); plant expression vectors containing the nopaline synthetase promoter (Herrera-Estrella et al., Nature 303:209-213 (1984)) or the cauliflower mosaic virus 35S RNA promoter (Gardner et al., Nucleic Acids Res. 9:2871 (1981)), and the promoter of the photosynthetic enzyme ribulose bisphosphate carboxylase (Herrera-Estrella et al., Nature 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); Mac-Donald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell. Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinkert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE30, and pQE31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from Novagen, Madison, Wis.; see, also literature published by Novagen describing the system). Such plasmids include pET11a, which contains the T7lac promoter, T7 terminator, the inducible *E. coli* lac operator, and the lac repressor gene; pET12a-c, which contains the T7 promoter, T7 terminator, and the *E. coli* ompT secretion signal; and pET15b and pET19b (Novagen, Madison, Wis.), which contain a His-Tag™ leader sequence for use in purification with a His column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

2. Expression

Hyaluronan degrading enzyme polypeptides, including soluble hyaluronidase polypeptides, can be produced by any method known to those of skill in the art including in vivo and in vitro methods. Desired proteins can be expressed in any organism suitable to produce the required amounts and forms of the proteins, such as for example, the amounts and forms needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Hyaluronan degrading enzyme polypeptides, such as soluble hyaluronidase polypeptides, also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g., a $his_6$ tag or a myc tag, or a tag for purification, for example, a GST fusion, and a sequence for directing protein secretion and/or membrane association.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated XPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as hyaluronidase polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1).

For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including hyaluronan degrading enzyme polypeptides, such as soluble hyaluronidase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NSO (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitate purification of secreted proteins from the cell culture media. Examples include CHO—S cells (Invitrogen, Carlsbad, Calif., cat #11619-012) and the serum free EBNA-1 cell line (Pham et al., (2003) *Biotechnol. Bioeng.* 84:332-342). Cell lines also are available that are adapted to grow in special media optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with agrobacterium-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthetase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

3. Purification Techniques

Method for purification of polypeptides, including hyaluronan degrading enzyme polypeptides (e.g., soluble hyaluronidase polypeptides) or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as soluble hyaluronidase polypeptides, can be purified using standard protein purification techniques known in the art including but not limited to, SDS-PAGE, size fraction and size exclusion chromatography, ammonium sulfate precipitation and ionic exchange chromatography, such as anion exchange chromatography. Affinity purification techniques also can be utilized to improve the efficiency and purity of the preparations. For example, antibodies, receptors and other molecules that bind hyaluronidase enzymes can be used in affinity purification. Expression constructs also can be engineered to add an affinity tag to a protein such as a myc epitope, GST fusion or $His_6$ and affinity purified with myc antibody, glutathione resin and Ni-resin, respectively. Purity can be assessed by any method known in the art including gel electrophoresis and staining and spectrophotometric techniques. Purified rHuPH20 compositions, as described herein, typically have a specific activity of at least 70,000 to 100,000 Units/mg, for example, about 120,000 Units/mg. The specific activity can vary upon modification, such as with a polymer.

I. FORMULATIONS AND ARTICLES OF MANUFACTURE

Provided herein are pharmaceutical compositions containing a hypoxia-activated agent for use in treatment of a hypoxia-related disease or condition (e.g., hyperproliferative disease or condition) in subjects selected as having a hypoxia-related disease or condition based on the level or expression of a hyaluronan-associated marker. The hypoxia-activated agent can be administered in a single agent therapy, or can be administered in a combination therapy with a further agent or treatment as described herein above. Also provided herein are pharmaceutical compositions containing an anti-hyaluronan agent for use in the treatment of hyaluronan-associated diseases or conditions, in particular those associated with hypoxia and that are hypoxia-related diseases or conditions, such as hyperproliferative diseases or conditions. The anti-hyaluronan agent can be administered as a single agent, or in combination therapy as described herein.

The compositions can be formulated for single dosage administration or for multiple dosage administration. The agents can be formulated for direct administration. The compositions can be provided as a liquid or lyophilized formulation.

1. Pharmaceutical Compositions and Formulations

Pharmaceutically acceptable compositions are prepared in view of approvals for a regulatory agency or other agency prepared in accordance with generally recognized pharmacopeia for use in animals and in humans. The compositions can be prepared as solutions, suspensions, powders, or sustained release formulations. Typically, the compounds are formulated into pharmaceutical compositions using techniques and procedures well known in the art (see e.g., Ansel *Introduction to Pharmaceutical Dosage Forms*, Fourth Edition, 1985, 126). The formulation should suit the mode of administration.

Compositions can be formulated for administration by any route known to those of skill in the art including intramuscular, intravenous, intradermal, intralesional, intraperitoneal injection, subcutaneous, intratumoral, epidural, nasal, oral, vaginal, rectal, topical, local, otic, inhalational, buccal (e.g., sublingual), and transdermal administration or any route. Other modes of administration also are contemplated. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition. Administration also can include controlled release systems including controlled release formulations and device controlled release, such as by means of a pump.

The most suitable route in any given case depends on a variety of factors, such as the nature of the disease, the progress of the disease, the severity of the disease and the particular composition which is used. Pharmaceutical compositions can be formulated in dosage forms appropriate for each route of administration. In particular, the compositions can be formulated into any suitable pharmaceutical preparations for systemic, intraperitoneal, oral or direct administration. For example, the compositions can be formulated for administration subcutaneously, intramuscularly, intratumorally, intravenously or intradermally.

Administration methods can be employed to decrease the exposure of a the active agent to degradative processes, such as proteolytic degradation and immunological intervention via antigenic and immunogenic responses. Examples of such methods include local administration at the site of treatment or continuous infusion (e.g., of anti-hyaluronan agent).

The compounds can be formulated into suitable pharmaceutical preparations such as solutions, suspensions, tablets, dispersible tablets, pills, capsules, powders, sustained release formulations or elixirs, for oral administrate, as well as transdermal patch preparation and dry powder inhalers. Typically, the compounds are formulated into pharmaceutical compositions using techniques and procedures well known in the art (see e.g., Ansel *Introduction to Pharmaceutical Dosage Forms*, Fourth Edition, 1985, 126). Generally, the mode of formulation is a function of the route of administration. The compositions can be co-formulated or provided as separate compositions. Generally, the compositions are formulated in lyophilized or liquid form. Where the compositions are provided in lyophilized form they can be reconstituted just prior to use by an appropriate buffer, for example, a sterile saline solution. The compositions can be provided together or separately. For purposes herein, such compositions typically are provided separately. The combinations can be packaged as a kit.

In one example, pharmaceutical preparation can be in liquid form, for example, solutions, syrups or suspensions. If provided in liquid form, the pharmaceutical preparations can be provided as a concentrated preparation to be diluted to a therapeutically effective concentration before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

Pharmaceutical compositions can include carriers such as a diluent, adjuvant, excipient, or vehicle with which the composition are administered. Examples of suitable pharmaceutical carriers are described in "Remington's Pharmaceutical Sciences" by E. W. Martin. Such compositions will contain a therapeutically effective amount of the compound or agent, generally in purified form or partially purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. For example, suitable excipients are, for example, water, saline, dextrose, glycerol or ethanol. A composition, if desired, also can contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose hydroxypropyl methylcellulose and polyvinylpyrrolidone. Emulsifying agents include Polysorbate 80 (TWEEN 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

Injectables can be prepared in conventional forms, either as liquid solutions or suspensions, solid forms suitable for solution or suspension in liquid prior to injection, or as emulsions. Suitable excipients are, for example, water, saline, dextrose, glycerol or ethanol. Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. The solutions may be either aqueous or nonaqueous. If administered intravenously, suitable carriers include physiological saline or phosphate buffered saline (PBS), and solutions containing thickening and solubilizing agents, such as glucose, polyethylene glycol, and polypropylene glycol and mixtures thereof.

In addition, if desired, the pharmaceutical compositions to be administered may also contain an activator in the form of a solvent such as pH buffering agents, metal ion salts, or other such buffers. The pharmaceutical compositions also may contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins. Implantation of a slow-release or sustained-release system, such that a constant level of dosage is maintained (see, e.g., U.S. Pat. No. 3,710,795) also is contemplated herein. The percentage of active compound contained in such parenteral compositions is highly dependent on the specific nature thereof, as well as the activity of the compound and the needs of the subject.

Of interest herein are lyophilized powders, which can be reconstituted for administration as solutions, emulsions and other mixtures. They may also be reconstituted and formulated as solids or gels. The lyophilized powders can be prepared from any of the solutions described above.

The sterile, lyophilized powder is prepared by dissolving a compound in a buffer solution. The buffer solution may contain an excipient which improves the stability or other pharmacological component of the powder or reconstituted solution, prepared from the powder. Subsequent sterile filtration of the solution followed by lyophilization under standard conditions known to those of skill in the art provides the desired formulation. Briefly, the lyophilized powder is prepared by dissolving an excipient, such as dextrose, sorbitol, fructose, corn syrup, xylitol, glycerin, glucose, sucrose or other suitable agent, in a suitable buffer, such as citrate, sodium or potassium phosphate or other such buffer known to those of skill in the art. Then, a selected enzyme, agent or compound is added to the resulting mixture, and stirred until it dissolves. The resulting mixture is sterile filtered or treated to remove particulates and to insure sterility, and apportioned into vials for lyophilization. Each vial will contain a single dosage (1 mg-1 g, generally 1-100 mg, such as 1-5 mg) or other dosages as described herein, or multiple dosages of the compound. The lyophilized powder can be stored under appropriate conditions, such as at about 4° C. to room temperature.

Reconstitution of this lyophilized powder with a buffer solution provides a formulation for use in parenteral administration. The precise amount depends upon the indication treated and selected compound. Such amount can be empirically determined.

Pharmaceutically and therapeutically active compounds and derivatives thereof are typically formulated and administered in unit dosage forms or multiple dosage forms. Each unit dose contains a predetermined quantity of therapeutically active compound sufficient to produce the desired therapeutic effect, in association with the required pharmaceutical carrier, vehicle or diluent. Unit dosage forms, include, but are not limited to, tablets, capsules, pills, powders, granules, sterile parenteral solutions or suspensions, and oral solutions or suspensions, and oil water emulsions containing suitable quantities of the compounds or pharmaceutically acceptable derivatives thereof. Unit dose forms can be contained ampoules and syringes or individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from non-toxic carrier can be prepared. Pharmaceutical composition can be formulated in dosage forms appropriate for each route of administration.

The concentration of the pharmaceutically active compound is adjusted so that an injection provides an effective amount to produce the desired pharmacological effect. The exact dose depends on the age, weight and condition of the patient or animal as is known in the art. The unit-dose parenteral preparations are packaged in an ampoule, a vial or a syringe with a needle. The volume of liquid solution or reconstituted powder preparation, containing the pharmaceutically active compound, is a function of the disease to be treated and the particular article of manufacture chosen for package. All preparations for parenteral administration must be sterile, as is known and practiced in the art.

a. Compositions of a Hypoxia-Activated Agent

For example, a hypoxia-activated agent (e.g., TH-302 and others known in the art such as any described herein) can be administered to patients in any pharmaceutically acceptable formulation. Typically, hypoxia-activated agents are prepared in lyophilized form, and are reconstituted immediately prior to use. Other stable preparations can be made and generated. For example, International PCT Publications WO 08/083,101 and WO 07/002,931 describe methods for preparing liquid pharmaceutical formulations of TH-302 and other related compounds. For example, as described in WO 07/002,931 TH-302 and related compounds can be provided as a lyophilized powder in a vial and reconstituted in saline or 5% dextrose in water immediately prior to administration. After reconstitution, the TH-302 formulation must be used within 8 hours. The shelf life for this lyophilized TH-302 formulation is about 1 year at 2-8° C. WO 08/083,101 describes that TH-302 and related compounds can be administered as a liquid formulation in ethanol (containing up to 50 mg of TH-302 per ml). Such formulations, however, are not suitable for high concentrations of drug, and the stability (particularly with respect to keeping the active agent from precipitating) during long term storage and/or dilution of TH-302 is suboptimal. In other examples, hypoxia-activated agents, such a those of the nitro-heteroaryl phosphoramide class of hypoxia-activated cancer drugs, such as TH-302, and other related compounds can be formulated with a nonionic surfactant (e.g., a sorbitan mono-oleate polyoxyethylene, CAS number 9005-65-6, TWEEN 80®) for prolonged storage in an alcohol (e.g., ethanol) environment (see e.g., WO 2010/048330).

b. Compositions of an Anti-Hyaluronan Agent

Typically, the dose of anti-hyaluronan agent (e.g., hyaluronan-degrading enzyme) is one that achieves a therapeutic effect in the treatment of a hyperproliferative disease or condition, such as cancer. Hence, compositions of a hyaluronan-degrading enzyme are included in an amount sufficient to exert a therapeutically useful effect. Generally, compositions contain 0.5 µg to 100 grams of an anti-hyaluronan-agent, such as a hyaluronan-degrading enzyme, for example, 20 µg to 1 mg, such as 100 µg to 0.5 mg or can contain 1 mg to 1 gram, such as 5 mg to 500 mg. In one example, anti-hyaluronan agents that are leflunomide, or derivatives thereof, generally are available as tablets containing 1-100 mg of active drug, for example, 1, 5, 10, 20, 30, 40, 50, 60, 70, 80, 90 or 100 mg of drug. The composition containing the active agent can include a pharmaceutically acceptable carrier.

The PEGylated hyaluronan degrading enzyme, such as a PEGylated hyaluronidase can be provided at a concentration of at or about or at least 50 U/mL, 100 U/mL, 150 U/mL, 200 U/mL, 400 U/mL, 500 U/mL, 1000 U/mL, 2000 Units/mL, 3000 U/mL, 4000 U/mL, 5000 U/mL, 6000 U/mL, 7000 U/mL, 8000 U/mL, 9000 U/mL, 10,000 U/mL, 11,000 U/mL, 12,000 U/mL, or 12,800 U/mL. The composition can be prepared for use directly or for dilution to the effective concentration prior to use. In one example, a polymer-conjugated hyaluronan-degrading enzyme, such as a PEG-hyaluronan degrading enzyme, can be provided as a stock solution for example, at 3.5 mg/mL at 112,000 U/mL (~32,000 U/mg), with a PEG to protein molar ratio between 5:1 and 9:1, for example, 7:1, or can be provided in a less concentrated form.

The anti-hyaluronan agent (e.g., hyaluronan degrading enzyme, such as a PEGylated hyaluronidase) can be provided as a liquid or lyophilized formulation. Lyophilized formulations are ideal for storage of large unit doses for later use or storage. The compositions also can be formulated as a tablet or capsule. The dose or compositions can be for single dosage administration or for multiple dosage administration.

2. Delivery Methods

Pharmaceutical compositions can be administered by controlled release formulations and/or delivery devices (see, e.g., in U.S. Pat. Nos. 3,536,809; 3,598,123; 3,630,200; 3,845,770; 3,847,770; 3,916,899; 4,008,719; 4,687,660; 4,769,027; 5,059,595; 5,073,543; 5,120,548; 5,354,556; 5,591,767; 5,639,476; 5,674,533 and 5,733,566).

Various delivery systems are known and can be used to administer selected compositions, such as but not limited to, encapsulation in liposomes, microparticles, microcapsules, recombinant cells capable of expressing the compound, receptor mediated endocytosis, and delivery of nucleic acid molecules encoding a soluble hyaluronidase or other agent such as retrovirus delivery systems.

Hence, in certain embodiments, liposomes and/or nanoparticles also can be employed with administration of compositions herein. Liposomes are formed from phospholipids that are dispersed in an aqueous medium and spontaneously form multilamellar concentric bilayer vesicles (also termed multilamellar vesicles (MLVs)). MLVs generally have diameters of from 25 nm to 4 µm. Sonication of MLVs results in the formation of small unilamellar vesicles (SUVs) with diameters in the range of 200 to 500 angstroms containing an aqueous solution in the core.

Phospholipids can form a variety of structures other than liposomes when dispersed in water, depending on the molar ratio of lipid to water. At low ratios, the liposomes form. Physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

Liposomes interact with cells via different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. Varying the liposome formulation can alter which mechanism is operative, although more than one can operate at the same time. Nanocapsules can generally entrap compounds in a stable and reproducible way. To avoid side effects due to intracellular polymeric overloading, such ultrafine particles (sized around 0.1 µm) should be designed using polymers able to be degraded in vivo. Biodegradable polyalkyl-cyanoacrylate nanoparticles that meet these requirements are contemplated for use herein, and such particles can be easily made.

3. Packaging and Articles of Manufacture

Also provided are articles of manufacture containing packaging materials, any pharmaceutical composition or combination provided herein, and a label that indicates that the compositions and combinations are to be used for treatment of a hypoxia-related disease or condition (e.g., hypoxic tumor or cancer). Such hypoxia-related diseases and conditions include hyaluronan-associated diseases and conditions that are associated with elevated or accumulated hyaluronan levels on tissues or cells. Exemplary of articles of manufacture are containers including single chamber and dual chamber containers. The containers include, but are not limited to, tubes, bottles and syringes. The containers can further include a needle for subcutaneous administration.

In one example, the article of manufacture contains a pharmaceutical composition contains a hypoxia-activated agent and no further agent or treatment. In other examples, the article of manufacture contains a pharmaceutical composition containing an anti-hyaluronan agent and no further agent. In another example, the article of manufacture contains pharmaceutical compositions containing the hypoxia-activated agent and another treatment such as an anti-hyaluronan agent, e.g., polymer-conjugated hyaluronan-degrading enzyme. In this example, the agents can be provided together or separately, for packaging as articles of manufacture.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment.

The choice of package depends on the agents, and whether such compositions will be packaged together or separately. In general, the packaging is non-reactive with the compositions contained therein. In other examples, some of the components can be packaged as a mixture. In other examples, all components are packaged separately. Thus, for example, the components can be packaged as separate compositions that, upon mixing just prior to administration, can be directly administered together. Alternatively, the components can be packaged as separate compositions for administration separately.

The components can be packaged in a container. The components are separately packaged in the same container. Generally, examples of such containers include those that have an enclosed, defined space that contains the polymer-conjugated hyaluronan-degrading enzyme, and a separate enclosed, defined space containing the other components or component such that the subsequent areas are separated by a readily removable membrane which, upon removal, permits the components to mix, or which permits the components to be separately administered. Any container or other article of manufacture is contemplated, so long as the agents are separated from the other components prior to administration. For suitable embodiments see e.g., containers described in U.S. Pat. Nos. 3,539,794 and 5,171,081.

Selected compositions including articles of manufacture thereof also can be provided as kits. Kits can include a pharmaceutical composition described herein and an item for administration provided as an article of manufacture. The kit can, optionally, include instructions for application including dosages, dosing regimens and instructions for modes of administration. Kits also can include a pharmaceutical composition described herein and an item for diagnosis.

J. METHODS OF TREATMENT OF HYPOXIA-RELATED CONDITIONS OR HYALURONAN-ASSOCIATED DISEASES AND CONDITIONS

Any of the compositions provided herein can be used in methods of treating subjects having a hypoxia-related condition and/or a hyaluronan-associated disease or condition. For example, the compositions provided herein can be used to treat disease or conditions characterized by hypoxia in which a cell or tissue that is deprived of oxygen is involved in or associated with progression, status or extent of the disease or condition, or is otherwise unamenable to treatments with other therapeutics because of the hypoxic conditions. For example, hypoxic tumors are resistant to treatments with chemotherapy or radiotherapy. Hence, the compositions provided herein provide alternative treatments for treating particular hypoxia-associated diseases and conditions. Further, as shown herein, the extent or level or amount of hyaluronan is associated with, and hence is a predictor of the degree of hypoxia. Hence, hypoxia-related diseases and conditions include hyaluronan-associated diseases and conditions (e.g., tumors such as solid tumors) that produce and assemble hyaluronan glycosaminoglycans. Hence, the compositions provided herein also can be used for treating hyaluronan-associated diseases and conditions, and in particular those that are also characterized by hypoxia.

For example, hyaluronan along with other extracellular matrix components can form a dense mass and contribute to high interstitial tumor pressure. The high interstitial fluid pressure above the intravascular pressure in the terminal arterioles and capillaries impairs perfusion of fluids and solutes into the interstitium. Thus, the high interstitial pressure associated with hyaluronan levels can also hamper uptake of therapeutics into tumor tissues, and also can affect the growth properties of tumor cells to support tumor cell proliferation. In the methods herein, administered anti-hyaluronan agents that inhibit HA synthesis or degrade hyaluronan, such as hyaluronan-degrading enzymes, e.g., hyaluronidases (e.g., PH20), can reduce hyaluronan such that the tissue deflates, the blood vessels expand, and more blood can flow through the site. This results in a diminishment of the interstitial fluid pressure at the tissue site and an associated increase in vascular perfusion. For example, hyaluronidase has been shown to remove HA from tumors resulting in the reduction of tumor volume, the reduction of intratumoral interstitial pressure, the slowing of tumor cell proliferation, and the enhanced efficacy of co-administered chemotherapeutic drugs and biological agents by enabling increased tumor penetration (see e.g., U.S. Patent Publication No. 20100003238 and International PCT Publication No WO 2009/128917). The treatment with an anti-hyaluronan-degrading enzyme can be monitored as described herein to assess that hypoxic activity is reduced or diminished.

Subjects selected as having a hypoxia-related disease or condition by virtue of a level or amount of a hyaluronan-associated marker also can be treated for the hypoxia-related disease or condition with a hypoxia-activated drug. In particular, subjects can be treated for a hyperproliferative disease or condition, such as a cancer, and in particular solid tumor cancers. The hypoxia-activated drug can be administered alone or in combination with (as a co-administration or co-formulation) with another second agent or treatment. In aspects of the methods of treating a hypoxia-related condition (e.g., a cancer or other hyperproliferative disease) herein, a therapeutically effective amount of a hypoxia activated agent alone or in combination with a therapeutically effective amount of another second agent is administered to a patient in need of such treatment thereby treating the disease or condition. In some cases, the therapy is administered to a patient that has been previously treated with an an anticancer agent or chemotherapeutic agent, but the cancer is progressing despite the therapy, or the therapy has been discontinued due to cancer progression.

Hypoxia-related conditions, which include hyaluronan-associated conditions, for treatment of selected patients herein includes any disease or condition in which hypoxia is involved in the etiology or progression of disease. In particular, hypoxia-related condition include cancer, angiogenesis and angiogenesis related disorders. For example, hypoxia promotes increased vascular growth and is thus associated with tumor growth and angiogeneic-related diseases or conditions. For example, excessive vascular growth is also known to contribute to non-neoplastic disorders, such as diabetic retinopathy, asthma, macular degeneration, psoriasis and rheumatoid arthritis.

Tumor growth is dependent on oxygen and nutrients supplied by the local tissue vasculature. Solid tumors are well known to be poorly oxygenated compared to normal tissue (In: Vaupel, P. W. et al., (eds.) Tumour Oxygenation pp 219-232: Gustav Fisher Verlag, 1995). Hypoxia (low cellular oxygen concentration, <1%) arises when tumor cells proliferate outside the diffusion zone of the local vascular supply. Tumors respond to hypoxia by producing hypoxia inducible factors (e.g., VEGF) that stimulate the growth of endothelial cells (the cells lining blood capillaries) from surrounding blood vessels (i.e., angiogenesis) (Weidner N, et al., *N Engl J Med,* 1991, 324(1):1-8). Blood flow in these tumor blood vessels is sluggish and irregular which results in less efficient oxygen delivery and propagates the hypoxic tendency of tumors (see e.g., Brown J. M. (2000) *Mol Med Today,* 6: 157-62). This hypoxia-induced angiogenic process allows tumor cells access to the host circulatory system. Furthermore, the new blood vessels provide a gateway for tumor cells to enter the circulation and metastasize to distant sites. In fact, the extent of neovascularity is strongly correlated with metastases in primary breast carcinoma, bladder cancer, prostate cancer, non-small cell lung cancer, cutaneous melanomas and uterine cervix carcinoma (reviewed in: Ferrara N, *Breast Cancer Res Treat,* 1995, 36:2, 127-37).

Carcinomas are known to have significant hypoxic fractions, e.g., 80% of the tumor for head and neck squamous cell carcinomas and 50% of the tumor for carcinoma of the uterine cervix (Van De Wiele, C et al., (2001) *Nuclear Med,* 22: 945-947). The hypoxic areas are heterogeneous and are partly due to the different oxygen tensions present throughout the tumor. Hypoxic areas of tumors tend to escape radiation and chemotherapy. These areas are the furthest away from blood vessels and hence can receive poor drug delivery. Hypoxia can induce relapse after treatment and the evolution of more aggressive and resistant tumors. Hypoxia increases the mutation rate of cells and results in mutated cell-types that are less susceptible to programmed cell death signals, such as p53. Overall, tumor hypoxia has emerged as a predictor of poor prognosis.

Furthermore, hypoxia is associated with other angiogenic processes. Under normal conditions, angiogenesis is necessary to facilitate wound healing, tissue repair, reproduction, growth and development. Many disease states, however, are also dependent upon this process. The process of wound healing is complex and represents a serious medical problem affecting a large number of individuals. Healing problems occurin dermal wounds, such as decubitus ulcers, severe burns, diabetic ulcers and eye lesions (including dry eye and corneal ulcers) as well as surgical wounds and other wound-related pathologies. One important aspect of wound healing is the controlled migration of new cells from tissues surrounding the wound-site. This is in order to establish a proper population of cell types and correct tissue organization in the newly developing tissue. Hypoxia promotes increased vascular growth and is thus associated with tumor growth as described above. Additionally, excessive vascular growth is also known to contribute to non-neoplastic disorders, such as diabetic retinopathy, asthma, macular degeneration, psoriasis and rheumatoid arthritis.

1. Cancers

The compositions provided herein can be used for the treatment of cancerous cells, neoplasms, tumors and metastases, as well as for the treatment of previously untreated cancers or refractory cancers. In combination with selecting subjects for treatment using the methods herein, the therapy provided herein permits a selective and specific treatment regime and method for cancer treatment. The therapy can result in a slowing or reduction of tumor growth, a decrease in tumor volume, and in some cases elimination or eradication of the tumor.

The cancer can be a lung cancer, liver cancer, prostate cancer or skin cancer. For example, the combination therapy can be used to treat a solid tumor, such as of the lung and bronchus, breast, colon and rectum, kidney, stomach, esophagus, liver and intrahepatic bile duct, urinary bladder, brain and other nervous system, head and neck, oral cavity and pharynx, cervix, uterine corpus, thyroid, ovary, testes, prostate, malignant melanoma, cholangiocarcinoma, thymoma, non-melanoma skin cancers, as well as hematologic tumors and/or malignancies, such as childhood leukemia and lymphomas, multiple myeloma, Hodgkin's disease, lymphomas of lymphocytic and cutaneous origin, acute and chronic leukemia such as acute lymphoblastic, acute myelocytic or chronic myelocytic leukemia, plasma cell neoplasm, lymphoid neoplasm and cancers associated with AIDS. Typically, the combination therapy is used for the treatment of solid tumors, for example, solid tumor stromal cancers. Exemplary tumors include, for example, pancreatic tumors, ovarian tumors, lung tumors, colon tumors, prostate tumors, cervical tumors and breast tumors.

The compositions provided herein, including hypoxia-activated agents, also can be used for the treatment of blood cancers (see e.g., International PCT Publication No. WO2012/006032). Hypoxia is associated with normal marrow hematopoiesis, the formation of blood cells from hematopoietic stem cells (Lennon et al., *J. Cell Physiol.*, 2001; 187(3):345-355; Morrison et al., *J. Neurosci.*, 2000, 20(19):7370-7376; and Parmar et al., *Proc Natl Acad Sci USA*. 2007, 104(13):5431-5436). Hence, hypoxia is relevant in the etiology and pathogenesis of abnormal hematopoiesis, and hypoxia-activated agents can target that abnormal hematopoiesis selectively, providing a treatment for blood cancers such as leukemias, lymphomas, and multiple myeloma. Illustrative blood cancers amenable to treatment include those selected from multiple myeloma, an acute leukemia, a chronic leukemia, an advanced phase chronic myelogenous leukemia (CML), myelodysplastic syndrome (MDS), a high risk MDS, myelofibrosis (MF), an advanced myelofibrosis, a chronic lymphocytic leukemia (CLL), and a relapsed or refractory form of any of the foregoing.

In particular, the cancer can be a cancer that is known or suspected of being rich in hyaluronan. Methods of selecting subjects for treatment as described herein can further select subjects having cancers amenable to treatment herein. Hyaluronan-rich cancers are suited for targeting by an anti-hyaluronan agent, such as a hyaluronan-degrading enzyme, and also are associated with hypoxic activity. Several hyaluronan-rich cancers have been identified. Hyaluronan-rich tumors include, but are not limited to, prostate, breast, colon, ovarian, stomach, head and neck and other tumors and cancers. In some cases, hyaluronan levels correlate with poor prognosis, for example, decreased survival rate and/or recurrence-free survival rate, metastases, angiogenesis, cancer cell invasion into other tissues/areas, and other indicators of poor prognosis. Such correlation has been observed, for example, in hyaluronan-rich tumors including ovarian cancer, SCC, ISC, prostate cancer, lung cancer, including non-small-cell lung cancer (NSCLC), breast cancer, colon cancer and pancreatic cancer (see, for example, Anttila et al., (2000) *Cancer Research*, 60:150-155; Karvinen et al., (2003) *British Journal of Dermatology*, 148:86-94; Lipponen et al., (2001) *Eur. Journal of Cancer*, 849-856; Pirinen et al., (2001) *Int. J. Cancer:* 95:12-17; Auvinen et al., (2000) *American Journal of Pathology*, 156(2):529-536; Ropponen et al., (1998) *Cancer Research*, 58: 342-347). Hyaluronan-degrading enzymes, such as hyaluronidase, have direct anticarcinogenic effects when injected into tumors. Hyaluronidase prevents growth of tumors transplanted into mice (De Maeyer et al., (1992) *Int. J. Cancer* 51:657-660) and inhibits tumor formation upon exposure to carcinogens (Pawlowski et al. (1979) *Int. J. Cancer* 23:105-109) Hyaluronidase is effective as the sole therapeutic agent in the treatment of brain cancer (gliomas) (see, International Pat. Pub. No. WO1988/02261).

2. Dosages for Administration

It is within the level of one of skill in the art to determine the precise amounts of active agents, including hypoxia-activated agent or anti-hyaluronan agent (e.g., polymer-conjugated hyaluronan-degrading enzyme) or other combination therapy to be administered to a subject. For example, such agents and uses for treating diseases and conditions, such as cancers and solid tumors, are well known in the art. Thus, dosages of such agents in a composition or combination therapy can be chosen based on standard dosing regimes for that agent under a given route of administration.

It is understood that the precise dosage and duration of treatment is a function of the tissue or tumor being treated and can be determined empirically using known testing protocols or by extrapolation from in vivo or in vitro test data and/or can be determined from known dosing regimes of the particular agent. It is to be noted that concentrations and dosage values can also vary with the age of the individual treated, the weight of the individual, the route of administration and/or the extent or severity of the disease and other factors that are within the level of a skilled medical practioner to consider. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects). It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof.

a. Hypoxia-Activated Agent

Hypoxia-activated agents, such as any described above or known in the art, can be administered for treatment of a hypoxia-related disease or condition, such as a hyperproliferative disease or condition (e.g., a tumor or cancer). In particular, the hypoxia-activated agents are administered to subjects identified or selected based on the presence of a hyaluronan-associated marker (e.g., hyaluronan) as described above.

Hypoxia-activated agents and pharmaceutical formulations thereof can be administered by any route. Thus, in one embodiment, administration is by the oral route. In other embodiments, administration is by parenteral (e.g., intramuscular, intraperitoneal, intravenous, ICV, intracisternal injection or infusion, subcutaneous injection, or implant), by inhalation spray nasal, and by vaginal, rectal, sublingual, urethral (e.g., urethral suppository) or topical (e.g., gel, ointment, cream, aerosol, etc.) routes.

Therapeutically effective concentration of a hypoxia-activated agent can be determined empirically by testing the compounds in known in vitro and in vivo systems, such as the assays described herein for monitoring or assessing hypoxia. For example, the dosage amount of a hypoxia-activated agent depends on absorption, inactivation and excretion rates, the physicochemical characteristics, the dosage schedule, and amount administered as well as other factors known to those of skill in the art. For example, it is understood that the precise dosage and duration of treatment is a function of the tissue being treated, the disease or condition being treated, the route of administration, the patient or subject and the particular hypoxia-activated agent and can be determined empirically using known testing protocols or by extrapolation from in vivo or in vitro test data and/or can be determined from known dosing regimes of the particular agent. Standard clinical techniques, in vitro assays and animal models can be employed to help identify optimal dosage ranges. The precise dosage, which can be determined empirically, can depend on the particular agent, the route of administration, the type of disease to be treated and the seriousness of the disease.

The hypoxia-activated agent is administered in a therapeutically effective dose. The therapeutically effective dose or amount is in the range of 0.01 mg/m$^2$ (of body surface area of patient)-10,000 mg/m$^2$, 0.1 mg/m$^2$-5000 mg/m$^2$, 1 mg/m$^2$-3000 mg/m$^2$, 10 mg/m$^2$-2000 m g/m$^2$, 100 mg/m$^2$-1000 mg/m$^2$, and 400 mg/m$^2$-800 mg/m$^2$. For an adult human patient, 1 mg/m$^2$ is equal to about 1.7 mg/kg. In various embodiments, the hypoxia-activated agent can be administered alone or in combination with another agent in an amount in the range of about 100 mg/m$^2$-about 700 mg/m$^2$, about 300 mg/m$^2$-about 600 mg/m$^2$, about 350 mg/m$^2$-about 550 mg/m$^2$, about 400 mg/m$^2$-about 500 mg/m$^2$, about 400 mg/m$^2$-about 600 mg/m$^2$, about 450 mg/m$^2$-about 550 mg/m$^2$, about 200 mg/m$^2$-about 500 mg/m$^2$, or about 200 mg/m$^2$-575 mg/m$^2$. For example, the hypoxia-activated agent can be administered at a dose of 200 mg/m$^2$-500 mg/m$^2$, such as at least or about at least or about 120 mg/m$^2$, 240 mg/m$^2$, 340 mg/m$^2$, 400 mg/m$^2$, 480 mg/m$^2$, and 560 mg/m$^2$. The particular dose that is administered can be less if given in combination with a second treatment for the hyperproliferative disease or condition (e.g., an anti-hyaluronan agent or other anti-cancer agent or chemotherapeutic). Hypoxia-activated agents, for example TH-302 and others known in the art and described herein, are typically administered intravenously, such as by infusion.

Such dose is generally the daily dose. Depending on the dose selected by the practitioner and the convenience of the patient, the entire daily dose can be administered once daily or the daily dose can be administered in multiple smaller doses throughout the course of a day. In certain embodiments, the hypoxia-activated agent can be administered daily, or once every other day, once a week, twice a week or once a month. In certain embodiments of the present invention, for combination treatment of cancer, the hypoxia-activated agent is administered weekly. Multiple daily administrations of a hypoxia-activated agent can also be employed. The hypoxia-activated agents need not, however, be administered daily; for example a daily dose used for some patients or indications can, in other patients or for other indications, be given every other day, or even less frequently. For example, cancer drugs are often given once a week or even less frequently. The frequency can be greater or lesser and depends on the particular patient, the particular hypoxia-activated agent, the dosage administered, the extent of the disease or condition, other treatments or therapies being given and other factors that can be empirically determined by a skilled physician. Treatment is continued for a period ranging from three days to weeks, months or years. Generally, the treatment can be continued until the symptoms of the disease or condition is reduced or ameliorated or until one or more adverse side effects occur.

For example, a hypoxia-activated agent can be administered according to a variety of schedules or cycles of administration, including those that are one week cycles, more than one week cycles, such as a 3 week, a 4 week cycle or a longer cycle of administration. For example, a hypoxia-activated agent can be administered once per week for three weeks followed by one week without administering the agent. In a 3 week administration cycle, the hypoxia-activated agent can be administered once weekly for 2 consecutive weeks followed by a week of no administered hypoxia-activated agent or, alternatively, can be administered once every 3 weeks. In a further example, a hypoxia-activated agent can administered once weekly for seven weeks followed by one week of no administration, followed by one or more 28-day cycles.

The hypoxia-activated agent can be administered alone or in combination with a second agent or treatment (e.g., an anti-hyaluronan agent or any other agent described further below). Generally, the hypoxia-activated agent is administered prior to administration of the second, non-hypoxia-activated anticancer agent. In instances of administration, administration of the hypoxia-activated agent is stopped at least 30 minutes to 12 hours, such as 30 minutes to one hour or at least 2-6 hours before administration of the second, non-hypoxia-activated anticancer agent is initiated.

b. Anti-Hyaluronan Agent

The anti-hyaluronan agent, such as a hyaluronidase for example a PH20 (e.g., PEGPH20), is administered in a therapeutically effective amount to degrade or cleave tumor-associated hyaluronan. A hyaluronan-degrading enzyme, such as a PEGylated hyaluronan degrading enzyme (e.g., a hyaluronidase), can be administered systemically, for example, intravenously (IV), intramuscularly, or by any another systemic route. Administration can be by injection or infusion, including continuous infusion. In particular examples, lower doses can be given locally. For example, local administration of a hyaluronan-degrading enzyme, such as a PEGylated hyaluronan degrading enzyme for example a PEGylated hyaluronidase (e.g., PH20) includes intratumoral administration, arterial injection (e.g., hepatic artery), intraperitoneal administration, intravesical administration and other local routes used for cancer therapy that can increase local action at a lower absolute dose.

The amount of anti-hyaluronan agent (e.g., hyaluronan degrading enzyme, such as a soluble hyaluronidase) to be administered for the treatment of a disease or condition, for example a cancer or solid tumor such as an HA-rich tumor, can be determined by standard clinical techniques. In addition, in vitro assays and animal models can be employed to help identify optimal dosage ranges. The precise dosage, which can be determined empirically, can depend on the particular enzyme, the route of administration, the type of disease to be treated and the seriousness of the disease.

Anti-hyaluronan agents, such as leflunomide or derivatives thereof, can be administered at 10 to 500 mg per day, typically 100 mg per day. The dosage can be continued as needed for treatment of the disease or conditions, or can be tapered or reduced to successively lower doses. For example, the agent (e.g., leflunomide) can be administered at an initial loading dose of 100 mg per day for three days and then administered at a continued dose of 20 mg/day.

Exemplary dosage ranges of a hyaluronan-degrading enzyme is at or about 50 Units to 50,000,000 Units of a hyaluronan-degrading enzyme (e.g., a hyaluronan-degrading enzyme conjugated to a polymer). It is understood herein that a unit of activity is normalized to a standard activity, for example, an activity as measured in a microturbidity assay assaying hyaluronidase activity. Thus, for example, a hyaluronan-degrading enzyme, such as a hyaluronidase for example a PH20, conjugated to polymer, for example, a PEG, can be administered at or about 10 to 50,000,000 Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 Units.

While dosages can vary depending on the disease and patient, the hyaluronan-degrading enzyme, such as a PEGylated hyaluronidase, is generally administered in an amount that is or is about in the range of from about 0.01 µg to 100 g per kg of body weight. For example, an effective amount of a hyaluronan-degrading enzyme is a dose ranging from 0.01 µg to 100 mg per kg of body weight, such as 0.01 µg to 1 mg per kg of body weight, 1 µg to 100 µg per kg of body weight, 1 µg to 10 µg per kg of body weight or 0.01 mg to 100 mg per kg of body weight. Generally, a hyaluronan-degrading enzyme (e.g., a polymer-conjugated hyaluronan-degrading enzyme) is administered to a subject in an amount that is between or about between 0.01 µg/kg to 25 mg/kg, such as 0.0005 mg/kg (0.5 µg/kg) to 25 mg/kg, 0.5 µg/kg to 10 mg/kg, 0.02 mg/kg to 1.5 mg/kg, 0.01 mg/kg to 15 µg/kg, 0.5 µg/kg to 100 µg/kg, 0.75 mg/kg, 0.05 mg/kg to 10 mg/kg, 0.75 mg/kg to 7.5 mg/kg or 1.0 mg/kg to 3.0 mg/kg. The hyaluronan-degrading enzyme (e.g., polymer-conjugated hyaluronan-degrading enzyme) can be administered, for example, at a dosage of at least or about at least 0.0005 mg/kg (body weight of the subject), 0.0006 mg/kg, 0.0007 mg/kg, 0.0008 mg/kg, 0.0009 mg/kg, 0.001 mg/kg, 0.0016 mg/kg, 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.016 mg/kg, 0.02 mg/kg, 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg/kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, 20 mg/kg, 21 mg/kg, 22 mg/kg, 23 mg/kg, 24 mg/kg, 25 mg/kg, or more is administered, to an average adult human subject, typically weighing about 70 kg to 75 kg. In particular examples, the hyaluronan-degrading enzyme (e.g., a polymer-conjugated or PEGylated hyaluronidase, such as PEGPH20) is administered at less than 20 µg/kg, for example 0.01 µg/kg to 15 µg/kg, 0.05 µg/kg to 10 µg/kg, 0.75 µg/kg to 7.5 µg/kg or 1.0 µg/kg to 3.0 µg/kg, such as at or about 0.01 µg/kg (body weight of the subject), 0.02 µg/kg, 0.03 µg/kg, 0.04 µg/kg, 0.05 µg/kg, 1.0 µg/kg, 1.5 µg/kg, 2.0 µg/kg, 2.5 µg/kg, 3.0 µg/kg, 3.5 µg/kg, 4.0 µg/kg, 4.5 µg/kg, 5.0 µg/kg, 5.5 µg/kg, 6.0 µg/kg, 7.0 µg/kg, 7.5 µg/kg, 8.0 µg/kg, 9.0 µg/kg, 10.0 µg/kg, 12.5 µg/kg or 15 µg/kg.

A hyaluronan-degrading enzyme, such as a polymer-conjugated or PEGylated hyaluronidase (e.g., PEGPH20), provided herein can be administered at between or about between 0.1 Unit/kg to 800,000 Units/kg, such as 10 to 800,000 Units/kg, 10 to 750,000 Units/kg, 10 to 700,000 Units/kg, 10 to 650,000 Units/kg, 10 to 600,000 Units/kg, 10 to 550,000 Units/kg, 10 to 500,000 Units/kg, 10 to 450,000 Units/kg, 10 to 400,000 Units/kg, 10 to 350,000 Units/kg, 10 to 320,000 Units/kg, 10 to 300,000 Units/kg, 10 to 280,000 Units/kg, 10 to 260,000 Units/kg, 10 to 240,000 Units/kg, 10 to 220,000 Units/kg, 10 to 200,000 Units/kg, 10 to 180,000 Units/kg, 10 to 160,000 Units/kg, 10 to 140,000 Units/kg, 10 to 120,000 Units/kg, 10 to 100,000 Units/kg, 10 to 80,000 Units/kg, 10 to 70,000 Units/kg, 10 to 60,000 Units/kg, 10 to 50,000 Units/kg, 10 to 40,000 Units/kg, 10 to 30,000 Units/kg, 10 to 20,000 Units/kg, 10 to 15,000 Units/kg, 10 to 12,800 Units/kg, 10 to 10,000 Units/kg, 10 to 9,000 Units/kg, 10 to 8,000 Units/kg, 10 to 7,000 Units/kg, 10 to 6,000 Units/kg, 10 to 5,000 Units/kg, 10 to 4,000 Units/kg, 10 to 3,000 Units/kg, 10 to 2,000 Units/kg, 10 to 1,000 Units/kg, 10 to 900 Units/kg, 10 to 800 Units/kg, 10 to 700 Units/kg, 10 to 500 Units/kg, 10 to 400 Units/kg, 10 to 300 Units/kg, 10 to 200 Units/kg, 10 to 100 Units/kg, 16 to 600,000 Units/kg, 16 to 500,000 Units/kg, 16 to 400,000 Units/kg, 16 to 350,000 Units/kg, 16 to 320,000 Units/kg, 16 to 160,000 Units/kg, 16 to 80,000 Units/kg, 16 to 40,000 Units/kg, 16 to 20,000 Units/kg, 16 to 16,000 Units/kg, 16 to 12,800 Units/kg, 16 to 10,000 Units/kg, 16 to 5,000 Units/kg, 16 to 4,000 Units/kg, 16 to 3,000 Units/kg, 16 to 2,000 Units/kg, 16 to 1,000 Units/kg, 16 to 900 Units/kg, 16 to 800 Units/kg, 16 to 700 Units/kg, 16 to 500 Units/kg, 16 to 400 Units/kg, 16 to 300 Units/kg, 16 to 200 Units/kg, 16 to 100 Units/kg, 160 to 12,800 Units/kg, 160 to 8,000 Units/kg, 160 to 6,000 Units/kg, 160 to 4,000 Units/kg, 160 to 2,000 Units/kg, 160 to 1,000 Units/kg, 160 to 500 Units/kg, 500 to 5000 Units/kg, 1000 to 100,000 Units/kg or 1000 to 10,000 Units/kg, of the mass of the subject to whom it is administered. In some examples, a hyaluronan-degrading enzyme, such as a polymer-conjugated hyaluronan-degrading enzyme, such as a PEGylated hyaluronidase (e.g., PEGPH20) can be administered at or about 1 Unit/kg to 1000 Units/kg, 1 Units/kg to 500 Units/kg or 10 Units/kg to 50 Units/kg.

For example, exemplary dosage range is at or about 0.3 Units/kg to 320,000 Units/kg, such as 10 Units/kg to 320,000 Units/kg of a PEGylated hyaluronidase, or a functionally equivalent amount of another PEGylated hyaluronan degrading enzyme. It is understood herein that a unit of activity is normalized to a standard activity, for example, an activity as measured in a microturbidity assay assaying hyaluronidase activity. A PEGylated soluble hyaluronidase can exhibit lower activity per mg of total protein, i.e., exhibits a lower specific activity, compared to a native soluble hyaluronidase not so conjugated. For example, an exemplary rHuPH20 preparation exhibits a specific activity of 120,000 Units/mg, while a PEGylated form of rHuPH20 exhibits a specific activity of at or about 32,000 Units/mg. Typically, a PEGylated form of a hyaluronan-degrading enzyme, such as a hyaluronidase for example rHuPH20, exhibits a specific activity within the range of between at or about 18,000 and at or about 45,000 U/mg.

Typically, volumes of injections or infusions of a hyaluronan-degrading enzyme (e.g., PEGylated hyaluronidase) contemplated herein are from at or about 0.5 mL, 1 mL, 2 mL, 3 mL, 4 mL, 5 mL, 6 mL, 7 mL, 8 mL, 9 mL, 10 mL, 15 mL, 20 mL, 30 mL, 40 mL, 50 mL or more. The volume administered is a function of the dosage required, but can be varied depending on the concentration of a hyaluronan degrading enzyme, such as soluble hyaluronidase, stock formulation available. For example, it is contemplated herein that the hyaluronan degrading enzyme, such as PEGylated hyaluronidase, is not administered in volumes greater than about 50 mL, and typically is administered in a volume of 5-30 mL, generally in a volume that is not greater than about 10 mL.

The composition can be administered in a single administration once, several times a week, twice weekly, every 15 days, 16 days, 17, 18, 19, 20, 21, 22, 23, 24, 25, 26, 27, 28, 29, or 30 days, once monthly, several times a year or yearly. In other examples, the dose or composition an be divided up and administered once, several times a week, twice weekly, every 15 days, 16 days, 17, 18, 19, 20, 21, 22, 23, 24, 25, 26, 27, 28, 29, or 30 days, once monthly, several times a year or yearly. For example, PEGylated hyaluronan-degrading enzyme, such as a hyaluronidase, for example PEGPH20, can be administered intravenously twice weekly, once weekly or once every 21 days. Typically, the PEGylated hyaluronan-degrading enzyme is administered twice weekly. The cycle of administration can be for a defined period, generally for 3 weeks or 4 weeks. The cycle of administration can be repeated in a dosage regime for more than one month, 2 months, 3 months, 4 months, 5 months, 6 months, 7 months, 8 months, 9 months, 10 months, 11 months, 1 year or more. Generally, the cycle of administration is repeated at the discretion of a treating physician, and can depend on factors such as remission of the disease or condition, severity of the disease or condition, adverse events and other factors. In other examples, in subsequent cycles of administration, the hyaluronan-degrading enzyme can be administered less frequently. For example, in a first cycle the hyaluronan-degrading enzyme is administered twice weekly for four weeks, and in subsequent cycles of administration the hyaluronan-degrading enzyme is administered once weekly or once every two weeks, once every 3 weeks (e.g., once every 21 days) or once every 4 weeks.

3. Combination Therapy

The compositions provided herein can be administered in a combination treatment, for example, for the treatment of a hypoxia-related disease or conditions, such as a hyperproliferative disease (e.g., a tumor or cancer). The compositions can be further co-formulated or co-administered together with, prior to, intermittently with, or subsequent to, other therapeutic or pharmacologic agents or treatments, such as procedures, for example, agents or treatments to treat a hypoxia-related disease or conditions, for example a hyperproliferative disease or condition (e.g., a tumor or cancer). Such agents include, but are not limited to, other biologics, anti-cancer agents, small molecule compounds, dispersing agents, anesthetics, vasoconstrictors and surgery, and combinations thereof. Such other agents and treatments that are available for the treatment of a disease or condition, including all those exemplified herein, are known to one of skill in the art or can be empirically determined. In some examples, a hypoxia-activated agent and an anti-hyaluronan agent (e.g., hyaluronan-degrading enzyme) are used in combination therapy in methods described herein, including in methods that include predicting, prognosing or monitoring treatments.

A preparation of a second agent or agents or treatment or treatments can be administered at once, or can be divided into a number of smaller doses to be administered at intervals of time. Selected agent/treatment preparations can be administered in one or more doses over the course of a treatment time for example over several hours, days, weeks, or months. In some cases, continuous administration is useful. It is understood that the precise dosage and course of administration depends on the indication and patient's tolerability. Generally, dosing regimes for second agents/treatments herein are known to one of skill in the art.

Generally, for treatments involving hypoxia-activated agent, the hypoxia-activated agent is administered prior to administration of the second agent or treatment preparation, where the hypoxic condition is amenable to treatment with a hypoxia-activated agent but is less amenable to treatment with another treatment. As treatment with the hypoxia-activated agent is effected, the extent of hypoxia is reduced or ameliorated, thereby rendering treatment with a second agent or treatment available. For example, the hypoxia-activated agent can be administered 0.5 minutes, 1 minute, 2 minutes, 3 minutes, 4 minutes, 5 minutes, 6 minutes, 7 minutes, 8 minutes, 9 minutes, 10 minutes, 20 minutes, 30 minutes, 1 hour, 2 hours, 3 hours, 4 hours, five hours, 6 hours, 12 hours, 24 hours or more prior to administration of the second agent preparation or treatment.

In other examples, the hypoxia-activated agent is administered together with or concurrently with the second agent preparation or treatment. As will be appreciated by those of skill in the art, the desired proximity of co-administration depends in significant part in the effective half lives of the agents in the particular tissue setting, and the particular disease being treated, and can be readily optimized by testing the effects of administering the agents at varying times in suitable models, such as in suitable animal models. In some situations, concurrent administration can be effected within a timing of administration of the hypoxia-activated agent and the second agent or treatment of 30 seconds to 60 minutes.

a. Anti-Cancer Agents and Other Treatments

The anticancer agent(s) or treatment(s) can be surgery, radiation, drugs, chemotherapeutics, polypeptides, antibodies, peptides, small molecules or gene therapy vectors, viruses or DNA.

Exemplary anti-cancer agents that can be administered after, coincident with or before administration of the PEGylated hyaluronan degrading enzyme, such as a PEGylated hyaluronidase, include, but are not limited to Acivicins; Avicin; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCl; Doxorubicin HCl liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates;

Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2 as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen Mustards; Megestrol acetates; Megestrols; Melengestrols; Melphalans; MelphalansIL-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofirans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars, for example:

Aldesleukins (e.g., PROLEUKIN®); Alemtuzumabs (e.g., CAMPATH®); Alitretinoins (e.g., PANRETIN®); Allopurinols (e.g., ZYLOPRIM®); Altretamines (e.g., HEXALEN®); Amifostines (e.g., ETHYOL®); Anastrozoles (e.g., ARIMIDEX®); Arsenic Trioxides (e.g., TRISENOX®); Asparaginases (e.g., ELSPAR®); BCG Live (e.g., TICE® BCG); Bexarotenes (e.g., TARGRETIN®); Bevacizumab (AVASTIN®); Bleomycins (e.g., BLENOXANE®); Busulfan intravenous (e.g., BUSULFEX®); Busulfan orals (e.g., MYLERAN®); Calusterones (e.g., METHOSARB®); Capecitabines (e.g., XELODA®); Carboplatins (e.g., PARAPLATIN®); Carmustines (e.g., BCNU®, BiCNU®); Carmustines with Polifeprosans (e.g., GLIADEL® Wafer); Celecoxibs (e.g., CELEBREX®); Chlorambucils (e.g., LEUKERAN®); Cisplatins (e.g., PLATINOL®); Cladribines (e.g., LEUSTATIN®, 2-CdA®); Cyclophosphamides (e.g., CYTOXAN®, NEOSAR®); Cytarabines (e.g., CYTOSAR-U®); Cytarabine liposomals (e.g., DepoCyt®); Dacarbazines (e.g., DTIC-Dome): Dactinomycins (e.g., COSMEGEN®); Darbepoetin Alfas (e.g., ARANESP®); Daunorubicin liposomals (e.g. DANUOXOME®); Daunorubicins/Daunomycns (e.g., CERUBIDINE®); Denileukin Diftitoxes (e.g., ONTAK®); Dexrazoxanes (e.g., ZINECARD®); Docetaxels (e.g., TAXOTERE®); Doxorubicins (e.g., ADRIAMYCIN®, RUBEX®); Doxorubicin liposomals, including Doxorubicin HCl liposome injections (e.g., DOXIL®); Dromostanolone propionates (e.g., DROMOSTANOLONE® and MASTERONE® Injection); Elliott's B Solutions (e.g., Elliott's B Solution®); Epirubicins (e.g., ELLENCE®); Epoetin alfas (e.g., EPOGEN®); Estramustines (e.g., EMCYT®); Etoposide phosphates (e.g., ETOPOPHOS®); Etoposide VP-16s (e.g., VEPESID®); Exemestanes (e.g., AROMASIN®); Filgrastims (e.g., NEUPOGEN®); Floxuridines (e.g., FUDR®); Fludarabines (e.g., FLUDARA®); Fluorouracils incl. 5-FUs (e.g., ADRUCIL®); Fulvestrants (e.g., FASLODEX®); Gemcitabines (e.g., GEMZAR®); Gemtuzumabs/Ozogamicins (e.g., MYLOTARG®); Goserelin acetates (e.g., ZOLADEX®); Hydroxyureas (e.g., HYDREA®); Ibritumomabs/Tiuxetans (e.g., ZEVALIN®); Idarubicins (e.g., IDAMYCIN®); Ifosfamides (e.g., IFEX®); Imatinib mesylates (e.g., GLEEVEC®); Interferon alfa-2 as (e.g., ROFERON-A®); Interferon alfa-2bs (e.g., INTRON A®); Irinotecans (e.g., CAMPTOSAR®); Letrozoles (e.g., FEMARA®); Leucovorins (e.g., WELLCOVORIN®, LEUCOVORIN®); Levamisoles (e.g., ERGAMISOL@); Lomustines/CCNUs (e.g., CeeBU®); Mechlorethamines/Nitrogen mustards (e.g., MUSTARGEN®); Megestrol acetates (e.g., MEGACE®); Melphalans/L-PAMs (e.g., ALKERAN®); Mercaptopurine, including 6-mercaptopurines (6-MPs; e.g., PURINETHOL®); Mesnas (e.g., MESNEX®); Methotrexates; Methoxsalens (e.g., UVADEX®); Mitomycin Cs (e.g., MUTAMYCIN®, MITOZYTREX®); Mitotanes (e.g., LYSODREN®); Mitoxantrones (e.g., NOVANTRONE®); Nandrolone Phenpropionates (e.g., DURABOLIN-50®); Nofetumomabs (e.g., VERLUMA®); Oprelvekins (e.g., NEUMEGA®); Oxaliplatins (e.g., ELOXATIN®); Paclitaxels (e.g., PAXENE®, TAXOL®); Pamidronates (e.g., AREDIA®); Pegademases (e.g., ADAGEN®); Pegaspargases (e.g., ONCASPAR®); Pegfilgrastims (e.g., NEULASTA®); Pentostatins (e.g., NIPENT®); Pipobromans (e.g., VERCYTE®); Plicamycin/Mithramycins (e.g., MITHRACIN®); Porfimer sodiums (e.g., PHOTOFRIN®); Procarbazines (e.g., MATULANE®); Quinacrines (e.g., ATABRINE®); Rasburicases (e.g., ELITEK®); Rituximabs (e.g., RITUXAN®); Sargramostims (e.g., PROKINE®); Streptozocins (e.g., ZANOSAR®); Sunitinib Malates (e.g., SUTENT®); Talcs (e.g., SCLEROSOL®); Tamoxifens (e.g., NOLVADEX®); Temozolomides (e.g., TEMODAR®); Teniposides/VM-26s (e.g., VUMON®); Testolactones (e.g., TESLAC®); Thioguanines including, 6-thioguanine (6-TG); Thiotepas (e.g., THIOPLEX®); Topotecans (e.g., HYCAMTIN®); Toremifenes (e.g., FARESTON®); Tositumomabs (e.g., BEXXAR®); Trastuzumabs (e.g., HERCEPTIN®); Tretinoins/ATRA (e.g., VESANOID®); Uracil Mustards; Valrubicins (e.g., VALSTAR®); Vinblastines (e.g., VELBAN®); Vincristines (e.g., ONCOVIN®); Vinorelbines (e.g., NAVELBINE®); and Zoledronates (e.g., ZOMETA®).

b. Corticosteroid

The compositions provided herein, and in particular anti-hyaluronan agent compositions, can be administered combination with one or more corticosteroids. The corticosteroid can be administered before, simultaneously, subsequently or intermittently with the compositions provided herein. A corticosteroid is administered is an amount that is therapeutically effective to ameliorate or reduce one or more adverse effects of administration of a polymer-conjugated hyaluronan degrading enzymes or other agent, in particular, adverse musculoskeletal effects. Indicators of improvement or successful pretreatment include determination of the failure to manifest a relevant score on the CTCAE scale or a change in grading or severity on the CTCAE scale.

Corticosteroids are a class of steroid hormones that are produced in the adrenal cortex. Corticosteroids are involved in a wide range of physiologic systems such as stress response, immune response and regulation of inflammation, carbohydrate metabolism, protein catabolism, blood electrolyte levels, and behavior. These include glucocorticoids, which are anti-inflammatory agents with a large number of other functions and mineralocorticoids, which control salt and water balance primarily through action on the kidneys.

Glucocorticoids are a class of steroid hormones, e.g., corticosteroids, that bind to the glucocorticoid receptor. Glucocorticoids cause their effects by binding to the glucocorticoid receptor. The activated glucocorticoid complex in turn upregulates the expression of anti-inflammatory proteins in the nucleus and represses the expression of pro-inflammatory proteins in the cytosol by preventing the translocation of other transcription factors from the cytosol into the nucleus.

Generally, any corticosteroid, e.g., glucocorticoid, can be used in the methods or combinations provided herein. The glucocorticoids include synthetic and non-synthetic glucocorticoids. Exemplary glucocorticoids include, but are not limited to: alclometasones, algestones, beclomethasones (e.g., beclomethasone dipropionate), betamethasones (e.g., betamethasone 17-valerate, betamethasone sodium acetate, betamethasone sodium phosphate, betamethasone valerate), budesonides, clobetasols (e.g., clobetasol propionate), clobetasones, clocortolones (e.g., clocortolone pivalate), cloprednols, corticosterones, cortisones and hydrocortisones (e.g., hydrocortisone acetate), cortivazols, deflazacorts, desonides, desoximetasones, dexamethasones (e.g., dexamethasone 21-phosphate, dexamethasone acetate, dexamethasone sodium phosphate), diflorasones (e.g., diflorasone diacetate), diflucortolones, difluprednates, enoxolones, fluazacorts, flucloronides, fludrocortisones (e.g., fludrocortisone acetate), flumethasones (e.g., flumethasone pivalate), flunisolides, fluocinolones (e.g., fluocinolone acetonide), fluocinonides, fluocortins, fluocortolones, fluorometholones (e.g., fluorometholone acetate), fluperolones (e.g., fluperolone acetate), fluprednidenes, fluprednisolones, flurandrenolides, fluticasones (e.g., fluticasone propionate), formocortals, halcinonides, halobetasols, halometasones, halopredones, hydrocortamates, hydrocortisones (e.g., hydrocortisone 21-butyrate, hydrocortisone aceponate, hydrocortisone acetate, hydrocortisone buteprate, hydrocortisone butyrate, hydrocortisone cypionate, hydrocortisone hemisuccinate, hydrocortisone probutate, hydrocortisone sodium phosphate, hydrocortisone sodium succinate, hydrocortisone valerate), loteprednol etabonate, mazipredones, medrysones, meprednisones, methylprednisolones (methylprednisolone aceponate, methylprednisolone acetate, methylprednisolone hemisuccinate, methylprednisolone sodium succinate), mometasones (e.g., mometasone furoate), paramethasones (e.g., paramethasone acetate), prednicarbates, prednisolones (e.g., prednisolone 25-diethylaminoacetate, prednisolone sodium phosphate, prednisolone 21-hemisuccinate, prednisolone acetate; prednisolone farnesylate, prednisolone hemisuccinate, prednisolone-21 (beta-D-glucuronide), prednisolone metasulphobenzoate, prednisolone steaglate, prednisolone tebutate, prednisolone tetrahydrophthalate), prednisones, prednivals, prednylidenes, rimexolones, tixocortols, triamcinolones (e.g., triamcinolone acetonide, triamcinolone benetonide, triamcinolone hexacetonide, triamcinolone acetonide 21-palmitate, triamcinolone diacetate). These glucocorticoids and the salts thereof are discussed in detail, for example, in Remington's Pharmaceutical Sciences, A. Osol, ed., Mack Pub. Co., Easton, Pa. (16th ed. 1980).

In some examples, the glucocorticoid is selected from among cortisones, dexamethasones, hydrocortisones, methylprednisolones, prednisolones and prednisones. In a particular example, the glucocorticoid is dexamethasone.

The corticosteroid is provided in a therapeutically effective dose. Therapeutically effective concentration can be determined empirically by testing in known in vitro or in vivo (e.g., animal model) systems. For example, the amount of a selected corticosteroid to be administered to ameliorate the adverse effects can be determined by standard clinical techniques. In addition, animal models can be employed to help identify optimal dosage ranges. The precise dosage, which can be determined empirically, can depend on the particular therapeutic preparation, the regime and dosing schedule, the route of administration and the seriousness of the disease. Generally, the dose of corticosteroid administered is dependent upon the specific corticosteroid, as a difference in potency exists between different corticosteroids. The corticosteroid, or glucocorticoid, for example dexamethasone, can be given orally (tablets, liquid or liquid concentrate) per os (PO), intravenously (IV) or intramuscularly. The corticosteroid is typically administered as a bolus, but many be administered over a period of time, as long as the dose is effective to ameliorate one or more side effects associated with administration of the anti-hyaluronan agent, for example, a PEGylated hyaluronidase.

The corticosteroid can be administered in any amount that is effective to ameliorate one or more side effects associated with administration of the hyaluronan degrading enzyme. Thus, the corticosteroid, e.g., glucocorticoid, can be administered, for example, at an amount between at or about 0.1 and 100 mgs, per dose, 0.1 to 80 mgs, 0.1 to 60 mgs, 0.1 to 40 mgs, 0.1 to 30 mgs, 0.1 to 20 mgs, 0.1 to 15 mgs, 0.1 to 10 mgs, 0.1 to 5 mgs, 0.2 to 40 mgs, 0.2 to 30 mgs, 0.2 to 20 mgs, 0.2 to 15 mgs, 0.2 to 10 mgs, 0.2 to 5 mgs, 0.4 to 40 mgs, 0.4 to 30 mgs, 0.4 to 20 mgs, 0.4 to 15 mgs, 0.4 to 10 mgs, 0.4 to 5 mgs, 0.4 to 4 mgs, 1 to 20 mgs, 1 to 15 mgs or 1 to 10 mgs, to a 70 kg adult human subject. Typically, the corticosteroid, such as a glucocorticoid is administered at an amount between at or about 0.4 and 20 mgs, for example, at or about 0.4 mgs, 0.5 mgs, 0.6 mgs, 0.7 mgs, 0.75 mgs, 0.8 mgs, 0.9 mgs, 1 mg, 2 mgs, 3 mgs, 4 mgs, 5 mgs, 6 mgs, 7 mgs, 8 mgs, 9 mgs, 10 mgs, 11 mgs, 12 mgs, 13 mgs, 14 mgs, 15 mgs, 16 mgs, 17 mgs, 18 mgs, 19 mgs or 20 mgs per dose, to an average adult human subject.

The corticosteroid can be administered, for example, at a dosage of at or about 0.001 mg/kg (body weight of the subject), 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.015 mg/kg, 0.02 mg/kg, 0.025 mg/kg, 0.03 mg/kg, 0.035 mg/kg, 0.04 mg/kg, 0.045 mg/kg, 0.05 mg/kg, 0.055 mg/kg, 0.06 mg/kg, 0.065 mg/kg, 0.07 mg/kg, 0.075 mg/kg, 0.08 mg/kg, 0.085 mg/kg, 0.09 mg/kg, 0.095 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.50 mg/kg, 0.55 mg/kg, 0.60 mg/kg, 0.65 mg/kg, 0.70 mg/kg, 0.75 mg/kg, 0.80 mg/kg, 0.85 mg/kg, 0.90 mg/kg, 0.95 mg/kg, 1 mg/kg, 1.05 mg/kg, 1.1 mg/kg, 1.15 mg/kg, 1.20 mg/kg, 1.25 mg/kg, 1.3 mg/kg, 1.35 mg/kg or 1.4 mg/kg, to an average adult human subject, typically weighing about 70 kg to 75 kg.

K. EXAMPLES

The following examples are included for illustrative purposes only and are not intended to limit the scope of the invention.

Example 1

Production and Purification of Recombinant Human PH20 (rHuPH20)

A. Generation of an Initial Soluble rHuPH20-Expressing Cell Line

Chinese Hamster Ovary (CHO) cells were transfected with the HZ24 plasmid (set forth in SEQ ID NO:52). The HZ24 plasmid vector for expression of soluble rHuPH20 contains a pCI vector backbone (Promega), DNA encoding amino acids 1-482 of human PH20 hyaluronidase (SEQ ID NO:49), an internal ribosomal entry site (IRES) from the ECMV virus (Clontech), and the mouse dihydrofolate reductase (DHFR) gene. The pCI vector backbone also includes DNA encoding the Beta-lactamase resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO:1), followed by a BamHI restriction site. The construct pCI-PH20-IRES-DHFR-SV40pa (HZ24), therefore, results in a single mRNA species, driven by the CMV promoter that encodes amino acids 1-482 of human PH20 (set forth in SEQ ID NO:3 and amino acids 1-186 of mouse dihydrofolate reductase (set forth in SEQ ID NO:53 separated by the internal ribosomal entry site (IRES).

Non-transfected CHO cells growing in GIBCO Modified CD-CHO media for DHFR(-) cells, supplemented with 4 mM Glutamine and 18 ml/L Pluronic F68/L (Gibco), were seeded at $0.5 \times 10^6$ cells/ml in a shaker flask in preparation for transfection. Cells were grown at 37° C. in 5% $CO_2$ in a humidified incubator, shaking at 120 rpm. Exponentially growing non-transfected CHO cells were tested for viability prior to transfection.

Sixty million viable cells of the non-transfected CHO cell culture were pelleted and resuspended to a density of $2 \times 10^7$ cells in 0.7 mL of 2× transfection buffer (2×HeBS: 40 mM Hepes, pH 7.0, 274 mM NaCl, 10 mM KCl, 1.4 mM $Na_2HPO_4$, 12 mM dextrose). To each aliquot of resuspended cells, 0.09 mL (250 μg) of the linear HZ24 plasmid (linearized by overnight digestion with ClaI (New England Biolabs) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 μF or at 350 V and 960 μF.

The cells were removed from the cuvettes after electroporation and transferred into 5 mL of Modified CD-CHO media for DHFR(-) cells, supplemented with 4 mM Glutamine and 18 ml/L Pluronic F68/L (Gibco), and allowed to grow in a well of a 6-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity using the microturbidity assay described in Example 2. Cells expressing the highest levels of hyaluronidase activity were collected from the tissue culture well, counted and diluted to $1 \times 10^4$ to $2 \times 10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL).

Ten clones were identified from the 5 plates grown without methotrexate. Six of these HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment). Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35 M was further expanded in 500 nM methotrexate in shaker flasks and gave rise to clones producing in excess of 1,000 Units/ml hyaluronidase activity (clone 3D35 M; or Gen1 3D35 M). A master cell bank (MCB) of the 3D35 M cells was then prepared.

B. Generation of a Second Generation Cell Line Expressing Soluble rHuPH20

The Gen1 3D35 M cell line described in Example 1A was adapted to higher methotrexate levels to produce generation 2 (Gen2) clones. 3D35 M cells were seeded from established methotrexate-containing cultures into CD CHO medium containing 4 mM GlutaMAX-1™ and 1.0 μM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 μM methotrexate.

After approximately 4 weeks, clones were identified and clone 3E10B was selected for expansion. 3E10B cells were grown in CD CHO medium containing 4 mM GlutaMAX-1™ and 2.0 µM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 µM methotrexate. After the 12$^{th}$ passage, cells were frozen in vials as a research cell bank (RCB). One vial of the RCB was thawed and cultured in medium containing 8.0 µM methotrexate. After 5 days, the methotrexate concentration in the medium was increased to 16.0 µM, then 20.0 µM 18 days later. Cells from the 8$^{th}$ passage in medium containing 20.0 µM methotrexate were cloned out by limiting dilution in 96-well tissue culture plates containing CD CHO medium containing 4 mM GlutaMAX-1™ and 20.0 µM methotrexate. Clones were identified 5-6 weeks later and clone 2B2 was selected for expansion in medium containing 20.0 µM methotrexate. After the 11th passage, 2B2 cells were frozen in vials as a research cell bank (RCB).

The resultant 2B2 cells are dihydrofolate reductase deficient (dhfr-) DG44 CHO cells that express soluble recombinant human PH20 (rHuPH20). The soluble PH20 is present in 2B2 cells at a copy number of approximately 206 copies/cell. Southern blot analysis of SpeI-, XbaI- and BamHI/HindIII-digested genomic 2B2 cell DNA using a rHuPH20-specific probe revealed the following restriction digest profile: one major hybridizing band of ~7.7 kb and four minor hybridizing bands (~13.9, −6.6, −5.7 and −4.6 kb) with DNA digested with SpeI; one major hybridizing band of ~5.0 kb and two minor hybridizing bands (~13.9 and −6.5 kb) with DNA digested with XbaI; and one single hybridizing band of ~1.4 kb observed using 2B2 DNA digested with BamHI/HindIII. Sequence analysis of the mRNA transcript indicated that the derived cDNA (SEQ ID NO:56) was identical to the reference sequence (SEQ ID NO:49) except for one base pair difference at position 1131, which was observed to be a thymidine (T) instead of the expected cytosine (C). This is a silent mutation, with no effect on the amino acid sequence.

C. Production of Gen2 soluble rHuPH20 in 300 L Bioreactor Cell Culture

A vial of HZ24-2B2 cells (Example 1B) was thawed and expanded from shaker flasks through 36 L spinner flasks in CD-CHO media (Invitrogen, Carlsbad, Calif.) supplemented with 20 µM methotrexate and GlutaMAX-1™ (Invitrogen). Briefly, a vial of cells was thawed in a 37° C. water bath, media was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached greater than $1.5 \times 10^6$ cells/mL, the culture was expanded into a 125 mL spinner flask in a 100 mL culture volume. The flask was incubated at 37° C., 7% $CO_2$. When the cell density reached greater than $1.5 \times 10^6$ cells/mL, the culture was expanded into a 250 mL spinner flask in 200 mL culture volume, and the flask was incubated at 37° C., 7% $CO_2$. When the cell density reached greater than $1.5 \times 10^6$ cells/mL, the culture was expanded into a 1 L spinner flask in 800 mL culture volume and incubated at 37° C., 7% $CO_2$. When the cell density reached greater than $1.5 \times 10^6$ cells/mL the culture was expanded into a 6 L spinner flask in 5000 mL culture volume and incubated at 37° C., 7% $CO_2$. When the cell density reached greater than $1.5 \times 10^6$ cells/mL the culture was expanded into a 36 L spinner flask in 32 L culture volume and incubated at 37° C., 7% $CO_2$.

A 400 L reactor was sterilized and 230 mL of CD-CHO media was added. Before use, the reactor was checked for contamination. Approximately 30 L cells were transferred from the 36 L spinner flasks to the 400 L bioreactor (Braun) at an inoculation density of $4.0 \times 10^5$ viable cells per ml and a total volume of 260 L. Parameters were temperature set point, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run nutrient feeds were added. At 120 hrs (day 5), 10.4 L of Feed #1 Medium (4×CD-CHO+33 g/L Glucose+160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+167 mL/L Yeastolate+0.92 g/L Sodium Butyrate) was added, and culture temperature was changed to 36.5° C. At 216 hours (day 9), 10.8 L of Feed #3 (1×CD-CHO+50 g/L Glucose+50 mL/L Glutamax-1™+250 mL/L Yeastolate+1.80 g/L Sodium Butyrate) was added, and culture temperature was changed to 36° C. At 264 hours (day 11), 10.8 L of Feed #4 (1×CD-CHO+33 g/L Glucose+33 mL/L Glutamax-1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per ml with a maximal cell density of 12 million cells/mL. At harvest, the culture was sampled for mycoplasma, bioburden, endotoxin and virus in vitro and in vivo, Transmission Electron Microscopy (TEM) and enzyme activity.

The culture was pumped by a peristaltic pump through four Millistak filtration system modules (Millipore) in parallel, each containing a layer of diatomaceous earth graded to 4-8 µm and a layer of diatomaceous earth graded to 1.4-1.1 µm, followed by a cellulose membrane, then through a second single Millistak filtration system (Millipore) containing a layer of diatomaceous earth graded to 0.4-0.11 µm and a layer of diatomaceous earth graded to <0.1 µm, followed by a cellulose membrane, and then through a 0.22 µm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filters (Sartorius), followed by a 10× buffer exchange with 10 mM Tris, 20 mM $Na_2SO_4$, pH 7.5 into a 0.22 µm final filter into a 50 L sterile storage bag.

The concentrated, diafiltered harvest was inactivated for virus. Prior to viral inactivation, a solution of 10% Triton X-100, 3% tri(n-butyl)phosphate (TNBP) was prepared. The concentrated, diafiltered harvest was exposed to 1% Triton X-100, 0.3% TNBP for 1 hour in a 36 L glass reaction vessel immediately prior to purification on the Q column.

D. Purification of Gen2 soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM $Na_2SO_4$, pH 7.5. Following viral inactivation, the concentrated, diafiltered harvest (Example 2A) was loaded onto the Q column at a flow rate of 100 cm/hr. The column was washed with 5 column volumes of 10 mM Tris, 20 mM $Na_2SO_4$, pH 7.5 and 10 mM Hepes, mM NaCl, pH 7.0. The protein was eluted with 10 mM Hepes, 400 mM NaCl, pH 7.0 into a 0.22 μm final filter into sterile bag. The eluate sample was tested for bioburden, protein concentration and hyaluronidase activity. $A_{280}$ absorbance readings were taken at the beginning and end of the exchange.

Phenyl-Sepharose (Pharmacia) hydrophobic interaction chromatography was next performed. A Phenyl-Sepharose (PS) column (19-21 L resin, H=29 cm, D=30 cm) was prepared. The wash was collected and sampled for pH, conductivity and endotoxin (LAL assay). The column was equilibrated with 5 column volumes of 5 mM potassium phosphate, 0.5 M ammonium sulfate, 0.1 mM $CaCl_2$, pH 7.0. The protein eluate from the Q sepharose column was supplemented with 2 M ammonium sulfate, 1 M potassium phosphate and 1 M $CaCl_2$ stock solutions to yield final concentrations of 5 mM, 0.5 M and 0.1 mM, respectively. The protein was loaded onto the PS column at a flow rate of 100 cm/hr and the column flow thru collected. The column was washed with 5 mM potassium phosphate, 0.5 M ammonium sulfate and 0.1 mM $CaCl_2$ pH 7.0 at 100 cm/hr and the wash was added to the collected flow thru. Combined with the column wash, the flow through was passed through a 0.22 μm final filter into a sterile bag. The flow through was sampled for bioburden, protein concentration and enzyme activity.

An aminophenyl boronate column (ProMedics) was prepared. The wash was collected and sampled for pH, conductivity and endotoxin (LAL assay). The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM Hepes, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and tested for pH, conductivity and endotoxin (LAL assay). The column was equilibrated with 5 mM potassium phosphate, 100 mM NaCl, 0.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM $CaCl_2$. The protein was eluted with 70 mM potassium phosphate, pH 7.0 and passed through a 0.22 μm sterile filter into a sterile bag. The eluted sample was tested for bioburden, protein concentration and enzyme activity.

The HAP purified protein was then passed through a viral removal filter. The sterilized Viosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM viral removal filter. The filtered protein in 70 mM potassium phosphate, pH 7.0 was passed through a 0.22 μm final filter into a sterile bag. The viral filtered sample was tested for protein concentration, enzyme activity, oligosaccharide, monosaccharide and sialic acid profiling. The sample also was tested for process related impurities.

Example 2

Determination of Hyaluronidase Activity of Soluble rHuPH20

Hyaluronidase activity of soluble rHuPH20 in samples such as cell cultures, plasma, purification fractions and purified solutions was determined using either a turbidimetric assay, which is based on the formation of an insoluble precipitate when hyaluronic acid binds with serum albumin, or a biotinylated-hyaluronic acid substrate assay, which measures the amount of enzymatically active rHuPH20 or PEGPH20 by the digestion of biotinylated hyaluronic acid (b-HA) substrate non-covalently bound to plastic multi-well microtiter plates.

A. Microturbidity Assay

Hyaluronidase activity of soluble rHuPH20 is measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample is measured at 640 nm after a 30 minute development period. The decrease in turbidity resulting from enzyme activity on the sodium hyaluronate substrate is a measure of the soluble rHuPH20 hyaluronidase activity. The method is performed using a calibration curve generated with dilutions of a soluble rHuPH20 assay working reference standard, and sample activity measurements are made relative to this calibration curve.

Dilutions of the sample were prepared in Enzyme Diluent Solutions. The Enzyme Diluent Solution was prepared by dissolving 33.0±0.05 mg of hydrolyzed gelatin in 25.0 mL of the 50 mM PIPES Reaction Buffer (140 mM NaCl, 50 mM PIPES, pH 5.5) and 25.0 mL of sterile water for injection (SWFI), and diluting 0.2 mL of 25% Buminate solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not less than 20 μL. The minimum sample volumes needed to perform the assay were as follows: In-process Samples, FPLC Fractions: 80 μL; Tissue Culture Supernatants: 1 mL; Concentrated Material: 80 μL; Purified or Final Step Material: 80 μL. The dilutions were made in triplicate in a Low Protein Binding 96-well plate, and 30 μL of each dilution was transferred to Optilux black/clear bottom plates (BD BioSciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 μL of Enzyme Diluent Solution were included in the plate as a negative control.

The plate was then covered and warmed on a heat block for 5 minutes at 37° C. The cover was removed and the plate was shaken for 10 seconds. After shaking, the plate was returned to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 μL sodium hyaluronate into each well. The plate was then removed from the MULTIDROP 384 and shaken for 10 seconds before being transferred to a heat block with the plate cover replaced. The plate was incubated at 37° C. for 10 minutes.

The MULTIDROP 384 was prepared to stop the reaction by priming the machine with Serum Working Solution and changing the volume setting to 240 µL (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384, and 240 µL of serum Working Solution was dispensed into the wells. The plate was removed and shaken on a plate reader for 10 seconds. After a further 15 minutes, the turbidity of the samples was measured at 640 nm and the hyaluronidase activity (in U/mL) of each sample was determined by fitting to the standard curve.

Specific activity (Units/mg) was calculated by dividing the hyaluronidase activity (U/ml) by the protein concentration (mg/mL).

B. Biotinylated Hyaluronan Assay

The biotinylated-hyaluronic acid assay measures the amount of enzymatically active rHuPH20 or PEGPH20 in biological samples by the digestion of a large molecular weight (~1.2 megadaltons) biotinylated hyaluronic acid (b-HA) substrate non-covalently bound to plastic multi-well microtiter plates. The rHuPH20 or PEGPH20 in standards and samples are allowed to incubate in a plate coated with b-HA at 37° C. After a series of washes, remaining uncleaved/bound b-HA is treated with Streptavidin Horseradish Peroxidase conjugate (SA-HRP). Reaction between immobilized SA-HRP and the chromogenic substrate, 3,3',5,5'-tetramethylbenzidine (TMB), produces a blue colored solution. After stopping the reaction with acid, formation of the soluble yellow reaction product is determined by reading the absorbance at 450 nm using a microtiter plate spectrophotometer. The decrease in absorbance at 450 nm resulting from enzyme activity on the biotinylated hyaluronic acid (b-HA) substrate is a measure of the soluble rHuPH20 hyaluronidase activity. The method is performed using a calibration curve generated with dilutions of a soluble rHuPH20 or PEGPH20 reference standard, and sample activity measurements are made relative to this calibration curve.

Dilutions of the sample and calibrator were prepared in Assay Diluent. The Assay Diluent was prepared by adding 1% v/v pooled plasma (from the appropriate species) to 0.1% (w/v) BSA in HEPES, pH 7.4. This was prepared daily and stored at 2-8° C. Depending upon the species type as well as the anticipated hyaluronidase level, single or multiple dilutions were prepared to ensure at least one sample dilution would fall within the range of the calibration curve. To guide the selection of test sample dilution(s), information known about the dose of hyaluronidase administered, the route of administration, approximate plasma volume of the species and the time point were used to estimate the hyaluronidase activity levels. Each sample dilution was mixed as it was prepared by brief pulse-vortexing and pipet tips were changed in between each dilution. In general, the dilutions began with an initial 50 or 100-fold dilution followed by additional serial dilutions. A seven-point calibration curve of rHuPH20 or PEGPH20 (depending upon the treatment administered) was prepared ranging in concentration from 0.004 to 3.0 U/mL for rHuPH20 and from 0.037 to 27 U/mL for PEGPH20. One-hundred microliters (100 µL) of each test sample dilution and calibration curve point was applied to triplicate wells of a 96-well microtiter plate (Immulon 4HBX, Thermo) that had been previously coated with 100 µL per well of b-HA at 0.1 mg/mL and blocked with 250 µL of 1.0% (w/v) Bovine Serum Albumin in PBS. Plate(s) were covered with an adhesive plate seal and incubated at 37° C. for approximately 90 minutes. At the end of the incubation period, the adhesive seal was removed from the plate, samples were aspirated and the plate washed five (5) times with 300 µL per well Wash Buffer (10 mM Phosphate Buffer, 2.7 mM Potassium Chloride, 137 mM Sodium Chloride, pH 7.4, with 0.05% (v/v) Tween 20, PBST) using an automated plate washer (BioTek ELx405 Select CW, Program '4HBX1'). One hundred microliters of Streptavidin-HRP Conjugate Working Solution [Streptavidin-HRP conjugate (1:5,000 v/v) in 20 mM Tris-HCl, 137 mM Sodium Chloride, 0.025% (v/v) Tween 20, 0.1% (w/v) Bovine Serum Albumin] was added per well. The plate was sealed and allowed to incubate at ambient temperature for approximately 60 minutes without shaking and protected from light. At the end of the incubation period, the adhesive seal was removed from the plate, samples were aspirated and the plate washed five (5) times with 300 µL per well Wash Buffer as described above. TMB solution (at ambient temperature) was added to each well and allowed to incubate protected from light for approximately five (5) minutes at room temperature. TMB Stop Solution (KPL, Catalog #50-85-06) was then added as 100 per well. The absorbance of each well at 450 nm was determined using a microtiter plate spectrophotometer. The response of the Calibration Curve on each plate was modeled using a 4-parameter logistic curve fit. The hyaluronidase activity of each unknown was calculated by interpolation from the calibration curve, corrected for sample dilution factor, and reported in U/mL.

Example 3

PEGylation of rHuPH20 rHuPH20 was PEGylated (PEGPH20) by reaction of the enzyme with linear N-hydroxysuccinimidyl ester of methoxy poly(ethylene glycol) butanoic acid (mPEG-SBA-30K).

A. Conjugation of mPEG-SBA-30K to rHuPH20 rHuPH20 (which is approximately 60 kDa in size), generated as described in Example 1, was covalently conjugated to a linear N-hydroxysuccinimidyl ester of methoxy poly(ethylene glycol) butanoic acid (mPEG-SBA-30K), having an approximate molecular weight of 30 kDa. The structure of mPEG-SBA is shown in scheme 2, below:

Scheme 2

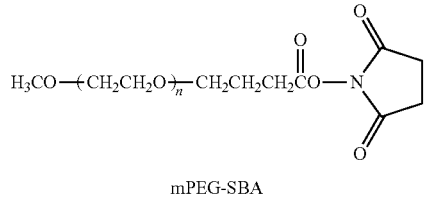

mPEG-SBA

Methods used to prepare the mPEG-SBA-30K that was used to PEGylate rHuPH20 are described, for example, in U.S. Pat. No. 5,672,662. Briefly, the mPEG-SBA-30K is made according to the following procedure:

A solution of ethyl malonate (2 equivalents) dissolved in dioxane is added drop by drop to sodium hydride (2 equivalents) and toluene under a nitrogen atmosphere. mPEG methane sulfonate (1 equivalent, MW 30 kDa, Shearwater) is dissolved in toluene and added to the above mixture. The resulting mixture is refluxed for approximately 18 hours. The reaction mixture is concentrated to half its original volume, extracted with 10% aqueous NaCl solution, extracted with 1% aqueous hydrochloric acid, and the aqueous extracts are combined. The collected aqueous layers are extracted with dichloromethane (3×) and the organic layer is dried with magnesium sulfate, filtered and evaporated to dryness. The resulting residue is dissolved in 1N sodium hydroxide containing sodium chloride and the mixture is stirred for 1 hour. The pH of the mixture is adjusted to approximately 3 by addition of 6N hydrochloric acid. The mixture is extracted with dichloromethane (2×).

The organic layer is dried over magnesium sulfate, filtered, concentrated, and poured into cold diethyl ether. The precipitate is collected by filtration and dried under vacuum. The resulting compound is dissolved in dioxane and refluxed for 8 hours and then concentrated to dryness. The resulting residue is dissolved in water and extracted with dichloromethane (2×), dried over magnesium sulfate, and the solution is concentrated by rotary evaporation and then poured into cold diethyl ether. The precipitate is collected by filtration and dried under vacuum. The resulting compound (1 equivalent) is dissolved in dichloromethane and N-hydroxysuccinimide (2.1 equivalents) is added. The solution is cooled to 0° C. and a solution of dicyclohexylcarbodiimide (2.1 equivalents) in dichloromethane is added dropwise. The solution is stirred at room temperature for approximately 18 hours. The reaction mixture is filtered, concentrated and precipitated in diethyl ether. The precipitate is collected by filtration and dried under vacuum to afford mPEG-SBA-30K.

To make the PEGylated rHuPH20, mPEG-SBA-30K was coupled to the amino group(s) of rHuPH20 by covalent conjugation, providing stable amide bonds between rHuPH20 and mPEG, as shown in Scheme 3.

2.5 mg peptide/mL). This PEGylated rHuPH20 material was filled, in 1 mL volumes, into a 13-mm Type-1 glass vial with brombutyl seal, and stored frozen (frozen overnight in a −20° C. freezer, then put in a −80° C. freezer for longer storage).

B. Analysis of PEGylated rHuPH20

The PEGylated rHuPH20 material was assayed by gel electrophoresis. Three batches of PEGylated rHuPH20, made as in Example 3A above, revealed an identical pattern of multiple bands, representing unreacted PEG and multiple species of mPEG-rHuPH20 conjugates, which migrated at different distances. Based on comparison with migration of a molecular weight marker, the bands representing the species ranged from approximately 90 kDa to 300 kDa, with three dark bands migrating above the 240 kDa marker. These data indicated that the PEGylated rHuPH20, generated by covalent conjugation of mPEG-SBA-30K, contained a heterogeneous mixture of PEGylated rHuPH20 species, likely including mono-, di- and tri-PEGylated proteins. The lack of a visible band at 60 kDa indicates that all the protein had reacted with the PEG, and that no detectable native rHuPH20 was present in the mixture.

Example 4

Effect of Intravenous PEGPH20 Administration in BxPC-3 Peritibial Human Pancreatic Cancer Tumor Model A tumor cell line-derived xenograft tumor was generated from BxPC-3 human pancreatic adenocarcinoma (ATCC CRL-1687). NCr (nu/nu) mice that were 5 to 6 weeks old and weighed between 20-25 g were inoculated with BxPC-3 cells ($5 \times 10^6$/50 µL) adjacent to the right tibial periosteum, gener- Scheme 3:

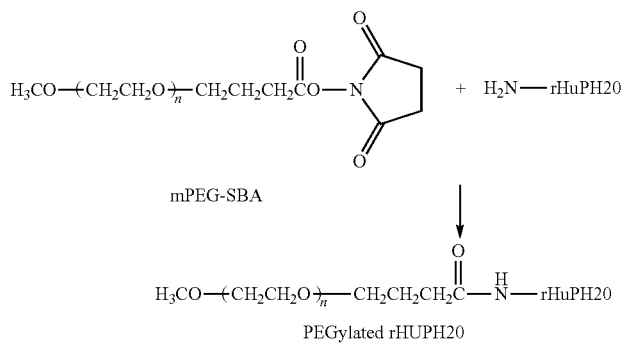

PEGylated rHUPH20

For the conjugation, the mPEG-SBA-30K was added in powder form to rHuPH20 (at a concentration of 10 mg/mL in 130 mM NaCl/10 mM HEPES; pH 7). The PEG:rHuPH$_2$O ratio was 10:1 (molar ratio). After the PEG had dissolved in the buffer, the solution was sterile-filtered (Corning 50 mL Tube top filter, polystyrene, cellulose acetate 0.22 µm membrane). The conjugation was carried out overnight, with stirring, at 4° C. in a cold room.

Following conjugation, the solution was concentrated, using a 100,000 MWCO TFF membrane, and buffer exchanged against 130 mM NaCl/10 mM HEPES at pH 6.8. The resulting material, which was tested for enzyme activity, as described in Example 2, above, was diluted using 130 mM NaCl/10 mM HEPES at pH 6.8 to obtain a final enzyme activity of 100,000 U/mL (corresponding to approximately ating high pressure tumors. The length (L) and width (W) of the solid tumor mass were measured by caliper and the tumor volume (TV) was calculated as: $(L \times W^2)/2$. When the volume of their tumors reached approximately 2000 mm$^3$ (n≥8/group), mice were staged into two treatment groups: (1) vehicle control and (2) PEGPH20 monotherapy. Animals were administered with either vehicle (10 mM Histidine, pH 6.5, 130 mM NaCl) or PEGPH20 (4.5 mg/kg) twice weekly for one week (at time 0 and 66 hours). Two hours prior to sacrifice (70 hours), animals were treated intraperitoneally with HYPOXYPROBE™ (pimonidazole hydrochloride; Chemicon International, Temecula, Calif.) at 60 mg/kg. Five minutes prior to sacrifice (72 hours), animals were treated intravenously with 75 µL of 0.6 mg/mL fluorescent carbocyanine dissolved in 75% DMSO (1,1'-dioctadecyl-3,3,3',3'-tetramethylindocarbocyanine perchlorate, DiI, Invitrogen, Carlsbad, Calif. USA). DiI is a lipophilic carbocyanine dye which diffuses laterally when administered intravenously to stain patent endothelial cells (Li et al. *Nat. Protoc.* 2008, 3(11):1703-08).

The animals were sacrificed at 72 hours. Whole tumors were harvested, tissues cooled to −20° C. on aluminum blocks, covered in embedding OCT medium (Sakura Finetek, Torrance, Calif.) and stored at −80° C. until sectioning. Tumor cryosections were cut into 10 μcm section and processed for immunohistochemistry or imaged microscopically. Effects on peritumoral hyaluronan (HA) and vascular perfusion were assessed.

A. Peritumoral Hyaluronan (HA)

Cryosections were analyzed for HA content by histochemistry using a biotinylated hyaluronan binding protein (B-HABP) as a probe for HA detection and digital quantification. Endogenous peroxidases were blocked with peroxoblock solution (Invitrogen, CA, USA) for 2 minutes. Non-specific staining was blocked using 2% BSA in 2% normal goat serum PBS for 1 hour at room temperature (RT) prior to incubation with 4.0 μg/ml biotinylated HA-binding protein (B-HABP, Catalog No. 400763, Seikagaku, Tokyo, Japan) for 1 hour at room temperature. After washing to remove the primary reagent, a FITC-labeled streptavidin (Vector Labs, Canada) was used as a secondary reagent for 30 minutes at room temperature and detected with 3,3'-diaminobenzidine (DAB; Dako, Catalog No. K3467). Sections were counter-stained using a DAPI (4',6-diamidino-2-phenylindole) reagent. Sections were dehydrated and mounted in Cytoseal 60 medium (American MasterTech). Micrographs were captured via a Nikon Eclipse TE2000U microscope coupled to a Insight FireWire digital camera (Diagnostic Instruments, Michigan).

HA expression in the tumor sections was analyzed by the level of fluorescent intensity in the sections. BxPC-3 xenograft tumors produced low to moderate levels of peritumoral HA. Compared to control animals, animals treated with 4.5 mg/kg of PEGPH20 had tumors which showed significantly reduced levels of peritumoral HA.

B. Vascular Perfusion

Non-stained, fresh cryosections were scanned with a fluorescence microscope imaging system (BD CARV II Confocal Imager, Sparks, Md.; Quentem 512sc Photometrics camera, Tuscon, Ariz.; MIV2000 motorized x-y stage, and Meta-Morph System, Sunnyvale, Calif.). Entire tumor sections were scanned at 10x for fluorescent carbocyanine (DiI) signal (Excitation 562 nm/emission 624 nm) to determine tumor perfusion. Images were analyzed using an Image-Pro Analyzer 7.0 (Media Cybermetrics, Bethesda, Md.). Whole tumor area and positive staining area were determined. The vascular perfusion in each tumor was calculated as percentage (signal) positive over entire tumor section.

The results are set forth in Table 4. The results show that PEG-PH20 mediated HA removal results in increased vascular perfusion in BxPC-3 tumors. A significant increase in blood vessel perfusion was seen in tumors from mice treated with PEGPH20 versus control treated tumors. As summarized in Table 5, PEGPH20-mediated HA removal resulted in an about 86% increase in tumor vascular perfusion.

TABLE 4

Vascular Perfusion

| Control-Treated Mice | Tumor Perfusion % | PEGPH20-Treated Mice | Tumor Perfusion % |
|---|---|---|---|
| C179 | 4.4024 | P75 | 10.818 |
| C181 | 7.9115 | P133 | 7.115 |
| C183 | 3.898 | P174 | 12.5704 |
| C203 | 4.694 | P175 | 11.178 |
| C304 | 5.238 | P222 | 8.2939 |
| C55 | 4.709 | P43 | 10.088 |
| C103 | 5.594 | P56 | 8.257 |
| C122 | 3.062 | P73 | 5.2346 |

TABLE 5

PEGPH20-Mediated Increase in Vascular Perfusion

| | Average % vascular area in whole tumor section | P | % increase |
|---|---|---|---|
| control (n = 8) | 4.94 ± 1.43 | — | — |
| PEGPH20 (n = 8) | 9.19 ± 2.4 | 0.0007 | 86 |

Example 5

Effect of PEGPH20 Treatment on BxPC-3 Tumor Hypoxic Regions

Tumor sections from mice treated with PEGPH20 or vehicle, obtained and processed as described in Example 4, were used to assess solid tumor hypoxia. As described in Example 4, two hours prior to sacrifice, animals were administered pimonidazole hydrochloride (HYPOXYPROBE™), which forms adducts with thiol groups in proteins, peptides, and amino acids under conditions of low oxygen concentration ($pO_2$<10 mmHg) and is therefore used as a hypoxia marker in solid tumors. Animals also were treated with fluorescent carbocyanine (DiI) five minutes prior to sacrifice. Specifically, tumor sections were processed for immunohistochemistry (for staining for the endothelial marker CD31 and staining for pimonidazole to detect hypoxic cells) and for microscopic imaging for carbocyanine DiI signal.

A. Visualization of Hypoxic Cells and Blood Vessel Position

Hypoxia, blood vessel position and tumor perfusion were assessed using pimonidazole, CD31 and carbocyanine, respectively. Images were analyzed with an Image-Pro Analyzer 7.0 (Media Cybermetrics, Bethesda, Md.).

Specifically, after sacrifice, cryosections that had been blocked with goat serum for non-specific staining were probed for 1 hour at room temperature with a 1:50 dilution of anti-pimonidazole antibody (Hypoxyprobe™-1 Mab-1, mouse $IgG_1$; Chemicon International, Temecula, Calif.) to detect pimonidazole adducts or with a 1:100 dilution anti-CD31 antibody (rat, BD Pharmingen, San Diego, Calif.) to detect endothelial cells. After washing to remove the primary reagent, either a FITC goat anti-mouse secondary antibody (to visualize Hypoxyprobe™-1 Mab-1, 1:100 dilution; Vector Labs Burlingame, Calif., USA) or a Texas Red goat anti-rat secondary antibody (to visualize CD31 endothelial cells) was used as a secondary reagent for 30 minutes at room temperature (1:100 dilution; Vector Labs Burlingame, Calif. USA. Sections were imaged using the Imaging System described in Example 4. For CD31 imaging, the excitation wavelength was 562 nm and an emission wavelength was 624 nm. For imaging for pimonidazole hydrochloride (HYPOXYPROBE™), the excitation wavelength was 490 nm and the emission wavelength was 520 nm.

Non-stained, fresh cryosections were also scanned with the Imaging System described in Example 4 for carbocyanine DI1 signal (Excitation 562 nm/emission 624 nm) to determine tumor perfusion.

Compound images were created and the spatial relationship between hypoxia and vasculature perfusion was evaluated. The results showed there was sparse perfusion (as determined by visualizing fluorescent carbocyanine D11) and an uneven distribution of hypoxic areas (as determined by staining for pimonidazole adducts by visualizing pimonidazole), which is typical of hypoperfused/hypovascular tumors. Endothelial staining (visualized with anti-CD31) was overlayed with hypoxic areas (pimonidazole staining), which showed that regions of the tumor with visibly open vessels are not hypoxic, whereas hypoxic regions are hypo-vascular.

B. Effect of PEGPH20 Treatment on Hypoxia

Tumor sections from control and PEGPH20 treated animals were compared for hypoxic regions by visualizing pimonidazole hydrochloride (HYPOXYPROBE™) as described in Example 5.A above. For each section, the whole tumor areas and positive staining areas were determined. The hypoxia fraction in each tumor was calculated as the percentage positive signal over the entire tumor section.

The results are set forth in Table 6. The results showed that PEGPH20, which mediates HA removal as shown in Example 4, results in reduced hypoxia in BxPC3 tumors. As summarized in Table 7, the results show that the hypoxic area in tumors was reduced by 66% following PEGPH20 treatment relative to vehicle treated controls.

TABLE 6

Hypoxic Areas

| Control-Treated Mice | Hypoxia % | PEGPH20-Treated Mice | Hypoxia % |
| --- | --- | --- | --- |
| C179 | 3.31 | P75 | 0.345 |
| C181 | 2.885 | P133 | 0.253 |
| C183 | 1.772 | P174 | 2.56 |
| C203 | 9.547 | P175 | 1.1341 |
| C304 | 2.76 | P222 | 0.4119 |
| C55 | 9.49 | P43 | 4.182 |
| C103 | 5.45 | P56 | 1.588 |
| C122 | 2.187 | P73 | 2.889 |

TABLE 7

PEGPH20-Mediated Decrease in Hypoxic Areas

| | % hypoxia area in whole tumor section | P | % decrease |
| --- | --- | --- | --- |
| control (n = 8) | 4.68 ± 3.18 | — | — |
| PEGPH20 (n = 8) | 1.67 ± 1.42 | 0.029 | 66 |

Example 6

Effect of PEGPH20 on Gemcitabine Anti-Tumor Activity in BxPC-3 Peritibial Tumors The BxPC-3 mouse xenograft tumor model described in Example 4 was also used to assess the effect of PEGPH20 pre-treatment on gemcitabine anti-tumor activity. When the volume of animal tumors reached approximately 2000 mm$^3$ (n≥8/group), mice were staged into four treatment groups: (1) vehicle control, (2) gemcitabine treatment, (3) PEGPH20 monotherapy, and (4) gemcitabine treatment plus PEGPH20 monontherapy. Animals were administered with either vehicle (10 mM Histidine, pH 6.5, 130 mM NaCl) or PEGPH20 (4.5 mg/kg) twice weekly for one week (at time 0 and 66 hours). Animals were treated with 240 mg/kg gemcitabine, intraperitoneally, 24 hours after the initial PEGPH20 treatment.

All animals were further administered intraperitoneally pimonidazole hydrochloride (HYPOXYPROBE™) at 60 mg/kg and 0.5 mL of 5-bromo-2'-deoxyuridine (Invitrogen, Calsbad, Calif. USA two hours prior to sacrifice (70 hours). Five (5) minutes prior to sacrifice (72 hours), animals were treated intravenously with 75 µL of fluorescent carbocyanine (1,1'-dioctadecyl-3,3,3',3'-tetramethylindocarbocyanine perchlorate, DiI).

Animals were sacrificed following treatment 72 hours after the initial administration of PEGPH20. Whole tumors were harvested, tissues cooled to −20° C. on aluminum blocks, covered in embedding OCT medium (Sakura Finetek, Torrance, Calif.) and stored at −80° C. until sectioning. Tumor cryosections were cut into 10 µm section and processed for immunohistochemistry or imaged microscopically. Effects on peritumoral hyaluronan (HA) and vascular perfusion were assessed.

A. Vascular Perfusion

Non-stained fresh cryosections were analyzed for fluorescent carbocyanine (DiI) staining by fluorescence microscope imaging as described in Example 4. Whole tumor area and positive staining area were determined. The vascular perfusion in each tumor was calculated as percentage positive signal over entire tumor section. The mean area of patent, perfusable tumor blood vessels was 2.89±1.92% in control animals. In gemcitabine treated animals, the mean area was slightly lower at 2.72±1.83%. The results showed an increase in vascular perfusion in PEGPH20 treated animals. Animals treated with PEGPH20 alone or PEGPH20 and gemcitabine had a mean area of perfusable blood vessels of 3.46%±1.73% or 3.85±1.57%, respectively.

B. Hypoxia

Tumor sections from treated animals were compared for hypoxic regions by visualizing pimonidazole hydrochloride (HYPOXYPROBE™) as described in Example 5.A above. For each section, the whole tumor areas and positive staining areas were determined. The hypoxia fraction in each tumor was calculated as the percentage positive signal over the entire tumor section.

Control animals had a mean percent hypoxic area in whole tumor section of 5.71±3.66%. Gemcitabine alone treated animals had a mean hypoxic area of 5.32±5.31%. Animals treated with PEGPH20 reduced the hypoxic area in tumors. Animals treated with PEGPH20 and animals treated with PEGPH20 and gemcitabine had a mean percent hypoxic area of 2.89±1.29% and 4.29±4.21%, respectively.

C. Anti-Tumor Activity of Gemcitabine

To determine the effect of PEGPH20 on the anti-tumor activity of gemcitabine, cells were stained with BrdU to assess cell proliferation. After the sections were imaged for pimonidazole, they were rinsed in PBS, placed in distilled water for 10 minutes, and then treated with 2 M HCl at room temperature for 1 hour, followed by neutralization for 5 minutes in 0.1 M sodium borate. Sections then were washed in distilled water and transferred to a PBS bath. Subsequent steps were each followed by a 5-minute wash in PBS. Incorporated BrdU was detected using a BrdU staining kit (Invitrogen, Calsbad, Calif. USA). In brief, tumor section was incubated with biotinylated mouse anti-BrdU antibody for 60 minutes, followed by Streptavidin-Peroxidase and a metal enhanced DAB substrate. Slides then were counterstained with hematoxylin, dehydrated, and mounted using Permount (Fisher Scientific, Hampton, N.H.) before imaging.

Slide images of proliferating nuclei were analyzed using Aperio PRECISION Image Analysis (Aperio ePathology Solutions, Vista, Calif.). Twenty images were taken per section, and 60 images were taken per group. Positive BrdU staining nuclei indicating cell proliferation were red and orange in color, whereas negative BrdU staining nuclei were yellow and blue in color. Both positive and total nuclei were counted using the Aperio PRECISION Image system to calculate a proliferating index equal to the number of positive nuclei divided by the total nuclei. This number was then multiplied by 100 to obtain a proliferation index.

The results are set forth in Table 8 and show that PEGPH20 enhances gemcitabine against proliferation. Thus, the results show that PEGPH20 increases the sensitivity of BxPC3 tumor cells to gemcitabine by reducing hypoxia.

TABLE 8

Anti-Tumor Activity (Proliferation Index)

| | Mean ± SD | p (PP vs C) | p (PR vs. G) | p (G + PP vs. PP) |
|---|---|---|---|---|
| Control (C) | 12.5 ± 4.28 | | | |
| Gemcitabine (G) | 8.37 ± 3.02 | ≤0.05 | | |
| PEGPH20 (PP) | 8.19 ± 3.20 | ≤0.05 | ≤0.05 | |
| Gemcitabine + PEGPH20 (G + PP) | 6.82 ± 2.05 | ≤0.05 | ≤0.05 | ≤0.05 |

Example 7

Effect of PEGPH20 Treatment in a High Peritumoral Hyaluronan (HA) Tumor Model

The BxPC-3 tumor as generated in the mouse xenograft tumor model described in Example 4 is a model of an HA$^{Low}$ tumor. To assess the effect of PEGPH20 on high levels of peritumoral HA, a BX-PC3-Has3 tumor cell line was generated to establish an HA$^{high}$ mouse xenograft tumor model. BxPC3 cells (ATCC Cat. No. CRL-1687) were cultured under standard culture conditions using complete RPMI media. A lentiviral system was generated to express the human hyaluronan synthase 3 cDNA transcript (set forth in SEQ ID NO:427). The generated lentiviral vector expressing hHAS3 cDNA was designated pLV-EF1a-hHAS3-IRES-Hyg and is set forth in SEQ ID NO:428. BX-PC3-Has3 stable cell line were generated by viral infection with pLV-EF1a-hHAS3-IRES-Hyg, followed by hygromycin selection. Cells infected to overexpress hHAS3 were used in all experiments.

To confirm HA levels, color intensity in the tumor section was measured with Aperio spectrum program. The tumor was graded as HA$^{High}$ at strong HA staining over 25% of tumor section; as HA$^{Moderate}$ at strong HA staining between 10 and 25% of tumor section; as HA$^{Low}$ at strong HA staining under 10% of tumor section.

NCr (nu/nu) mice that were 5 to 6 weeks old and weighed between 20-25 g were inoculated with BxPC-3-Has3 cells ($5\times10^6$/50 µL) adjacent to the right tibial periosteum, generating high pressure tumors. The length (L) and width (W) of the solid tumor mass were measured by caliper and the tumor volume (TV) was calculated as: $(L\times W^2)/2$. When the volume of tumors reached approximately 1500 to 2000 mm$^3$ in diameter, mice were staged into two treatment groups: (1) BxPC3 HA$^{high}$, vehicle control or (2) BxPC3 HA$^{high}$, PEGPH20.

Animals were administered with either vehicle (10 mM Histidine, pH 6.5, 130 mM NaCl) or PEGPH20 (4.5 mg/kg) at 0 hours and again at 42 hours. With the first PEGPH20 or vehicle control treatment (at 48 hours prior to sacrifice, i.e., at t=0 hrs), animals also were treated with 240 mg/kg gemcitabine, intraperitoneally, and 10 mg/kg paclitaxel (Abraxane®), intravenously. Two hours prior to sacrifice (46 hours), animals were treated intraperitoneally with HYPOXYPROBE™ (pimonidazole hydrochloride; Chemicon International, Temecula, Calif.) at 60 mg/kg and also with 0.5 mL of BrdU. Five minutes prior to sacrifice (48 hours), animals were treated intravenously with 75 µL of 0.6 mg/mL fluorescent carbocyanine dissolved in 75% DMSO 1,1'-dioctadecyl-3,3,3',3'-tetramethylindocarbocyanine perchlorate (DiI).

The animals were sacrificed at 48 hours. Whole tumors were harvested, tissues cooled to −20° C. on aluminum blocks, covered in embedding OCT medium (Sakura Finetek, Torrance, Calif.) and stored at −80° C. until sectioning. Tumor cryosections were cut into 10 µm section and processed for immunohistochemistry or imaged microscopically. Effects on vascular perfusion and tumor hypoxia were assessed.

A. Vascular Perfusion

Non-stained fresh cryosections were analyzed for fluorescent carbocyanine (DiI) staining by fluorescence microscope imaging as described in Example 4. Whole tumor area and positive staining area were determined. The vascular perfusion in each tumor was calculated as percentage positive signal over entire tumor section.

The results are set forth in Table 9. The results show that PEG-PH20 treatment mediated dye perfusion in BxPC3-HAS3 tumors, with a significant increase in blood vessel perfusion in tumors from mice treated with PEGPH20 versus control treated tumors. As summarized in Table 9, animals treated with PEGPH20 showed an increase in vascular perfusion with a mean area of 7.24±1.78, which is a 116.9% increase over control animals. This increase in tumor perfusion was greater than observed in BxPC3 tumors containing low peritumoral, which showed an 86% increase in vascular perfusion (see Example 4 and Table 5). Thus, the results indicate that PEGPH20 therapy is more effective in increasing tumor perfusion in BxPC3-Has3 tumors than in BxPC3 tumors showing that the effects on perfusion is HA-removal dependent.

TABLE 9

PEGPH20-Mediated Increase in Vascular Perfusion in HA$^{high}$ tumors

| | Average % vascular area in whole tumor section | P | % increase |
|---|---|---|---|
| control (n = 7) | 3.42 ± 0.53 | — | — |
| PEGPH20 (n = 6) | 7.24 ± 1.78 | <0.0001 | 116.9 |

B. Hypoxia

Tumor sections from treated animals were compared for hypoxic regions by visualizing pimonidazole hydrochloride (HYPOXYPROBE™) as described in Example 5 above. For each section, the whole tumor areas and positive staining areas were determined. The hypoxia fraction in each tumor was calculated as the percentage positive signal over the entire tumor section.

The results are set forth in Table 10. The results showed that PEGPH20, which mediates HA removal as shown in Example 4, results in reduced hypoxia in BxPC3-Has3 tumors. Control animals had a mean percent hypoxic area in whole tumor section of 3.98±2.70%. Animals treated with PEGPH20 had reduced hypoxia area in tumors with a mean area of 0.86±1.07, which is a 78% decrease over control animals. This decrease in tumor hypoxia was greater than observed in Example 5 upon treatment of BxPC3 tumors (HA$^{low}$). Thus, the results show that PEGPH20 therapy is more effective in BxPC3-Has3 tumors than in BxPC3 tumors, and that hypoxia reduction is HA-removal dependent.

TABLE 10

PEGPH20-Mediated Decrease in Hypoxic Areas in HA$^{high}$ tumors

| | % hypoxia area in whole tumor section | P | % decrease |
|---|---|---|---|
| control (n = 7) | 3.98 ± 2.70 | — | — |
| PEGPH20 (n = 6) | 0.86 ± 1.07 | 0.035 | 78 |

Example 8

Generation of TSG-6 Link Module IgG Fc Fusion Protein

A fusion protein, TSG-6-LM-Fc, containing the link module of TSG-6 and the Fc domain of IgG was generated. A mutant fusion protein TSG-6-LM-Fc/ΔHep in which the heparin binding region of the TSG-6 link module was mutated, also was generated.

A. Vector Construction of Recombinant Human TSG-6 Link Module Fusion Proteins

DNA de novo synthesis (GenScript, NJ) was employed to generate nucleic acid encoding the TSG-6-LM-Fc fusion protein. The nucleic acid contains a DNA encoding a human immunoglobulin light chain kappa (κ) leader signal peptide sequence (SEQ ID NO:210), a 669 bp-long cDNA fragment of human IgG1 heavy chain (GI No. 5031409; SEQ ID NO:203, encoding the peptide sequence set forth in SEQ ID NO:204) and a 285 bp-long cDNA fragment of human TSG-6 link module region (SEQ ID NO:216, encoding the peptide sequence set forth in SEQ ID NO:207, which corresponds to amino acid positions 35 to 129 of the TSG-6 preprotein, GI No. 315139000, set forth in SEQ ID NO:205 (mRNA) and SEQ ID NO:206 (protein)). The human IgG1 heavy chain and human TSG-6 link module regions were connected with a 6 bp AgeI restriction enzyme cleavage site GACAAAACT-CAC (SEQ ID NO:208) and a 12 bp sequence encoding four additional amino acids (DKTH; SEQ ID NO:209) originally published as part of the IgG1 Fc sequence (*Nucleic Acids Research*, 1982, Vol. 10, p4041). Two unique restriction enzyme cleavage sites, NheI at 5' end and BamHI at 3' end, were synthesized flanking the fusion protein sequence. The synthesized fragment has the sequence set forth in SEQ ID NO:217. The fragment was codon optimized for improved protein expression and synthesized by de novo DNA synthesis. The codon optimized fragment has the sequence set forth in SEQ ID NO:211. The protein sequence for the encoded TSG-6-LM-Fc fusion protein is set forth in SEQ ID NO:212.

The synthesized codon optimized fragment was inserted via NheI and BamHI cleavage sites into the pHZ24 IBES bicistronic mammalian expression vector (SEQ ID NO:52) using well-known recombinant DNA procedures (restriction enzyme and ligation reagents obtained from New England Biolabs, Ipswich, Mass.) to generate pHZ24-TSG-6-LM-Fc construct (SEQ ID NO:213). Recombinant protein expression in this vector is driven by a CMV promoter.

In order to enhance the hyaluronan (HA) binding specificity and reduce binding to other GAG chains, a construct encoding a mutant fusion protein, TSG-6-LM-Fc/ΔHep, that contains 3 lysine to alanine mutations at amino acid positions corresponding to positions 55, 69, 76 of the TSG-6 link module with reference to positions set forth in SEQ ID NO:206 was constructed. The mutations reduce the heparin binding activity of the TSG-6 link module, while not affecting the HA binding activity (see Mahoney D J et al. (2005) *J Biol. Chem.* 280:27044-27055, which reports 10-fold lower heparin binding activity for the triple mutant; K20A/K34A/K41A in the heparin binding site). TSG-6-LM-Fc/ΔHep was generated by mutagenesis of the nucleic acid fragment encoding the TSG-6-LM-Fc fusion protein and insertion into the pHZ24 IRES vector to generate pHZ24-TSG-6-LM-Fc/ΔHep (SEQ ID NO:218). The sequence of the TSG-6-LM-Fc/ΔHep fragment is set forth in SEQ ID NO:214, which encodes the TSG-6-LM-Fc/ΔHep fusion protein set forth in SEQ ID NO:215.

B. Recombinant Protein Expression and Purification

FreeStyle CHO—S suspension cells (Invitrogen) were employed for expression of TSG-6-LM-Fc and TSG-6-LM-Fc/ΔHep fusion proteins. The FreeStyle CHO—S suspension cell line was maintained in CHO—S CD culture medium (Invitrogen) prior to transfection. For preparation of the cells for transfection and recombinant protein expression, FreeStyle CHO—S cells were cultured in FreeStyle CHO Expression Medium (Invitrogen) supplemented with 8 mM L-glutamine in shake flasks at 37° C. in a humidified atmosphere of 8% $CO_2$ in air on an orbital shaker platform rotating at 125 rpm with loosened caps of flasks to allow for aeration.

Transient transfection of suspension cells was performed according to the manufacturer's instructions. Briefly, cells were split at a density $6 \times 10^5$/ml 24 hours before transfection, and transfected using FreeStyle Max lipid with a DNA/lipid ratio at 1:1. After 96 hours post-transfection, cells were harvested at 4,000 g for 20 min, and supernatants were collected. A time course analysis of protein expression level during the post-transient transfection revealed that the protein expression level reached a plateau after 96 hours post transfection. Thus, the recombinant protein was collected at 96 hour post-transfection.

The expressed TSG-6-LM-Fc and TSG-6-LM-Fc/ΔHep fusion proteins in the collected supernatants were affinity purified by Protein A resins (Bio-Rad, Hercules, Calif.) according to the manufacturer's instructions. Briefly, the collected supernatants were adjusted to pH 7.4, 0.15 M NaCl with 1 M Tris-HCl, pH 7.4 (Teknova Catalog No. T1074) and 5 M NaCl (Sigma) and diluted with binding buffer 3 fold before loaded onto a Protein A column. The eluted product was immediately neutralized with 1 M Tris-HCl, pH 8.5, and dialyzed against Phosphate-Balanced Solution (PBS, 137 mM NaCl, 2.7 mM KCl, 8 mM $Na_2HPO_4$, 1.46 mM $KH_2PO_4$, and pH 7.4) at 4° C., and stored at −20° C. The yield of the purified proteins from the supernatants through a single step Protein A affinity column was between 3 to 5 mg/liter.

C. SDS-PAGE and Western Blot Analysis of Expressed Recombinant Proteins

The purity, size and identity of the purified fusion protein were determined by SDS-PAGE 4-20% gradient gel under reducing and non-reducing conditions and Western Blot analysis. 60 ng of purified protein was used in the analysis.

The size of the purified fusion proteins were about 40 kDa under reducing conditions and about 80 kDa under non-reducing conditions, indicating the expressed proteins form homodimers via disulfide bonds in hinge region of IgG Fc. The purity of the protein samples were greater than 95%. The purified proteins were stable in PBS for at least one month at 4° C. without any visible degradation, and loss of binding activity.

The identity of the TSG-6 link module in TSG-6-LM-Fc and TSG-6-LM-Fc/ΔHep were assessed by Western blot with goat anti-human TSG-6 IgG (R&D Systems, Inc., Minneapolis, Minn.) followed by rabbit anti-goat IgG-HRP (EMD, San Diego, Calif.). Recombinant full length human TSG-6 protein (R&D Systems, Inc., Minneapolis, Minn.) was employed as a positive control. The pattern of detected proteins by Western blot analysis under reducing and non-reducing conditions was the same as that of SDS-PAGE analysis except for a small amount of upper bands observed under the non-reducing condition, most likely representing tetramers of the recombinant proteins based on their molecular weight size.

The identity of the Fc portion in the purified recombinant proteins was confirmed by Western blot analysis with HRP-rabbit anti-human IgGFc (Jackson ImmunoResearch, West Grove, Pa.). The pattern of detected proteins was the same as for the SDS-Page and anti-TSG-6 analyses, indicating that the purified proteins contain both TSG-6 link module (LM) as well as hIgGFc.

To analyze whether the proteins were glycosylated, the purified proteins were treated with glycosidase PNGase F (0.5 units per ng protein), which removes the N-linked oligosaccharides from proteins, and analyzed by SDS-PAGE and Western blot. A 5 kDa difference of molecular weights of proteins was observed between before and after treatment with PNGase F, indicating that the expressed proteins were glycolated.

Example 9

Binding of TSG-6 to Hyaluronan and Heparin

Two formats were used to test the binding of both TSG-6-LM-Fc and its mutant to HA and heparin. In one format, binding of TSG-6-LM-Fc and TSG-6-LM-Fc/ΔHep to immobilized HA or Heparin on a microplate was employed. In the second format, binding of biotinylated HA and heparin to immobilized recombinant TSG-6-LM-Fc and TSG-6-LM-Fc/ΔHep proteins on a microplate was employed.

A. Binding of Recombinant TSG-6-LM-Fc and TSG-6-LM-Fc/ΔHep to Immobilized HA and Heparin Wild type and mutant TSG-6-LM Fc fusion homodimers were tested for their HA binding and heparin binding activities using either HA or heparin-coated microplates. Briefly, hyaluronan with an average MW of about 1000 kDa (Lifecore, Chaska, Minn.) or Heparin with an average MW of 15 kDa (Calbiochem, San Diego, Calif.) at a concentration of 100 μg/ml in 0.5 M sodium carbonate buffer, pH 9.6, was dispensed into 96-well plates in duplicate, 100 μl/well, and incubated at 4° C. overnight. Plates were blocked with 1% BSA in PBS to reduce non-specific binding.

TSG-6-LM-Fc and TSG-6-LM-Fc/ΔHep purified protein samples were diluted to give rise to concentration range from 0.31 to 40 ng/ml for binding to HA coated plate, 0.78 to 100 ng/ml for binding to heparin coated plate. For each sample, 100 μl per well in duplicate was added to the microplate and incubated at room temperature for 1 hour. Plates were washed with PBS with 0.05% Tween 20, 5 times to remove unbound protein. Hyaluronan or heparin bound TSG-6-LM-Fc and TSG-6-LM-Fc/ΔHep were detected with rabbit anti-human IgG Fc-HRP (Jackson ImmunoResearch, West Grove, Pa.) followed by TMB (3,3',5,5'-tetramethylbenzidine) substrate (KPL, Gaithersburg, Md.). The samples were incubated 60 minutes with the rabbit anti-human IgG Fc-HRP antibody. After washing, bound HRP was detected with TMB solution over 10-15 minutes development time followed by addition of phosphoric acid reagent to stop color development. Absorbance was measured at OD450 using a Molecular Devices, Spectra M3 spectrophotometer.

Both TSG-6-LM-Fc and TSG-6-LM-Fc/ΔHep displayed the same HA binding activity on the HA coated plate; and their titration curves of HA binding activity were almost overlapped, indicating that the two expressed proteins bind HA with high affinity based on the $EC_{50}$ values from titration curves of HA binding. The triple mutation in heparin binding site has no effect on its HA binding. In contrast, the binding of the two proteins to the heparin coated plate showed a significant difference. The wild type TSG-6-LM-Fc bound heparin although with relatively low binding activity compared to its binding to HA, which could be due to the size difference of the two GAG chains coated on the plates. The mutant TSG-6-LM-Fc protein exhibited about 10% of heparin binding activity compared to that of wild type, which was consistent with the reported result for the triple-mutated TSG-6-LM monomer (Mahoney D J et al. (2005)).

B. Binding of Biotinylated HA and Heparin to Immobilized Recombinant TSG-6-LM-Fc and TSG-6-LM-Fc/ΔHep The GAG binding properties of wild type TGS6-LM-Fc and TSG-6-LM-Fc/ΔHep were further examined by coating microplates with the recombinant proteins and assessing their binding to biotinylated HA and biotinylated heparin.

For preparation of the microplates, TSG-6-LM-Fc and TSG-6-LM-Fc/Hep at a concentration of 2 μg/ml in 1×PBS buffer was dispensed into 96-well plates in duplicates, 100 μl/well, and incubated at 4° C. overnight. Plates were blocked with 1% BSA in PBS to reduce non-specific binding.

TSG-6-LM-Fc and TSG-6-LM-Fc/ΔHep purified protein samples were diluted to give rise to concentration range from 0.31 to 40 ng/ml for binding to HA coated plate, 0.78 to 100 ng/ml for binding to heparin coated plate. 100 μl per well for each sample in duplicate was added to the microplate and incubated at room temperature for 1 hour. Hyaluronan or heparin bound TSG-6-LM-Fc and TSG-6-LM-Fc/ΔHep were detected with anti-human IgG Fc-HRP (Jackson ImmunoResearch, West Grove, Pa.) followed by TMB (3,3',5,5'-tetramethylbenzidine) substrate (KPL, Gaithersburg, Md.).

For biotinylation of HA, the carboxyl groups on HA were used for the conjugation via hydrazide chemistry. Briefly, biotin-hydrazide was dissolved in DMSO at a concentration 25 mM, and added at a volume ratio of 6:100 into an HA solution, containing 1000 kDa or 150 kDa molecular weight HA (Lifecore Biomedical, LLC Chaska, Minn.) at 1 mg/ml in 0.1 M MES, pH 5.0. 1-Ethyl-3-[3-dimethylaminopropyl]carbodiimide hydrochloride (ECD) and sulfo-N-Hydroxysuccinimide (sulfo-NHS) were added in the conjugation reaction to a concentration of 40 μM and 850 μM, respectively, to mediate the conjugation of biotin-hydrazide and HA. The reaction was kept at 4° C. overnight while stirring. The excess amount of chemicals was removed from biotinylated HA by dialysis. Biotinylated heparin was purchased from EMD, San Diego (Catalog No. 375054).

Biotinylated hyaluronan or heparin were diluted in PBS with concentration range from 0.78 ng/ml to 100 ng/ml, dispensed 100 μl/well, and incubated at room temperature for 1 hour. Plates were washed with PBS with 0.05% Tween 20, 5 times to remove unbound protein. The bound biotinylated hyaluronan and heparin were detected with anti-Streptavidin-HRP (Jackson ImmunoResearch, West Grove, Pa.) followed by TMB substrate (3,3',5,5'-tetramethylbenzidine) substrate (KPL, Gaithersburg, Md.) as described above. Absorbance was measured at OD450.

The binding results observed were similar to the binding assay performed in Example 9A, which used immobilized HA and heparin and free TSG-6-LM-Fc and TSG-6-LM-Fc/ ΔHep. There was no difference of binding activity of immobilized TSG-6-LM-Fc and TSG-6-LM-Fc/ΔHep to biotinylated HA or in the binding titration curves between TSG-6-LM-Fc and TSG-6-LM-Fc/ΔHep, and a significant reduction in the binding of mutant TSG-6-LM-Fc/ΔHep to biotinylated heparin compared to that of wild type protein also was observed. Therefore, the HA and heparin binding properties of wild type TSG-6-LM-Fc and its mutant can be evaluated in either GAG coated or recombinant protein coated format; and both formats revealed similar binding patterns.

C. Calculation of Binding Affinity of TSG-6-LM-Fc

The HA binding affinity of TSG-6-LM-Fc was measured using Bio-Layer Interferometry (BLI) technology via Octet QKe instrument (ForteBio, Menlo Park, Calif.). The full length TSG-6 recombinant protein (R&D Systems, Inc., Minneapolis, Minn.) was used as control. Briefly, biotinylated HA with an average molecular weight of 150 kDa was immobilized on streptavidin coated biosensors for 240 seconds. TSG-6-LM-Fc and TSG-6-LM-Fc/ΔHep were then associated with immobilized HA for 180 seconds at different concentrations in PBS at pH 6.0 or pH 7.4, followed by dissociation of bound proteins in PBS at pH 6.0 or pH 7.4 for 240 seconds. The results of binding kinetics were analyzed by the software provided by the manufacturer. Results for the calculated binding affinity are provided in Table 11.

TABLE 11

Binding Affinity of TSG-6-LM-Fc

| Sample ID | Conc. (nM) | pH | KD (M) | kon (1/Ms) | kdis (1/s) | Full R^2 |
|---|---|---|---|---|---|---|
| TSG-6-LM-Fc | 18.8 | 6.0 | 5.45E−09 | 2.46E+05 | 1.34E−03 | 0.970616 |
| TSG-6-LM-Fc | 6.25 | 6.0 | 5.45E−09 | 2.46E+05 | 1.34E−03 | 0.970616 |
| TSG-6-LM-Fc | 18.8 | 7.4 | 1.41E−08 | 4.44E+04 | 6.24E−04 | 0.986378 |
| TSG-6-LM-Fc | 6.25 | 7.4 | 1.41E−08 | 4.44E+04 | 6.24E−04 | 0.986378 |

Example 10

Competitive Inhibition Assessment of TSG-6 Binding to Hyaluronan and Heparin by Other Glycosaminoglycans The HA and heparin GAG binding sites of the TSG-6 link module are located at different regions of the link module. In order to determine whether the two binding sites would interfere with each other during the interaction with TSG-6 link module or in the presence of other GAG chains, a competitive inhibition assay was performed to assess binding of HA or heparin in the presence of other GAG chains.

HA and heparin coated 96-well microplates were prepared as described in Example 9A. TSG-6-LM-Fc and TSG-6-LM-Fc/ΔHep, at a concentration of 40 ng/ml for the HA coated plates and 100 ng/ml for the Heparin coated plates, were pre-incubated with four different GAG chains: HA (Lifecore Biomedical, LLC Chaska, Minn.), chondroitin sulfate A (EMD, San Diego, Calif., Catalog No. 230687) chondroitin sulfate C (EMD, San Diego, Calif., Catalog No. 2307) and heparin sulfate (EMD, San Diego, Calif., Catalog No. 375095), at three different concentrations (0.11, 0.33, 1.0 µg/ml) or without GAG chain as control at room temperature for 10 minutes. The samples were then dispensed (100 µl) in duplicate into the HA and heparin coated 96-well microplates and incubated at room temperature for 1 hour. Plates were washed with PBS with 0.05% Tween 20, 5 times, to remove unbound protein. Bound TSG-6-LM-Fc and TSG-6-LM-Fc/ ΔHep were detected with anti-human IgG Fc-HRP (Jackson ImmunoResearch, West Grove, Pa.) followed by TMB (3,3', 5,5'-tetramethylbenzidine) substrate (KPL, Gaithersburg, Md.) as described above. Absorbance was measured at OD450.

For the HA coated plate, both TSG-6-LM-Fc and TSG-6-LM-Fc/ΔHep revealed similar competitive inhibition patterns. Binding of TSG-6-LM-Fc to the immobilized HA was efficiently inhibited by pre-incubation of same amount of protein with the different doses of free HA (approximately 68%, 85%, and 93% inhibition for the 0.11, 0.33, 1.0 µg/ml doses, respectively), but was not affected by pre-incubation with different doses of free heparin or chondroitin sulfate C. Some inhibition of TSG-6-LM-Fc and TSG-6-LM-Fc/ΔHep were observed for pre-incubation with chondroitin sulfate A, though it was less than for HA (approximately 23%, 43%, and 63% inhibition for the 0.11, 0.33, 1.0 µg/ml doses). Thus, an approximately 10 fold higher amount of chondroitin sulfate A was needed for inhibition. (In independent experiments up to 30-fold higher amount of chondroitin sulfate A was needed for inhibition compared to HA). Because TSG-6-LM-Fc and TSG-6-LM-Fc/ΔHep showed similar inhibition with pre-incubation with chondroitin sulfate A, it is likely that the HA binding site in TSG-6 link module is responsible for the chondroitin sulfate A binding.

For the heparin coated plates, the binding of TSG-6-LM-Fc to heparin was efficiently inhibited not only by pre-incubation with heparin, but also by pre-incubation with either HA or chondroitin sulfate A. This data shows that the binding of TSG-6-Fc-LM to HA could block its heparin binding activity. As expected, mutant TSG-6-LM-Fc/ΔHep did not bind heparin and thus exhibited readings close to background for both control and pre-incubation samples.

This study demonstrates that binding of link module of TSG-6 to HA is not affected by the presence of free heparin or preformed TSG-6 heparin complex, while its binding to heparin is significantly inhibited by the presence of free HA or preformed TSG-6 HA. Based on these observations, one can conclude that TSG-6-LM binds to HA and heparin simultaneously or binding of TSG-6-LM to HA is stronger than its binding to heparin. HA and TSG-6-LM complex formation can cause protein conformation change or other arrangements of the protein that are not favorable for its binding to heparin.

Example 11

Comparison of Glycosaminoglycan Binding Properties of TSG-6-LM-Fc, TSG-6-LM-Fc/ΔHep and HABP In this example, the specificity and binding activity of TSG-6-LM-Fc, TSG-6-LM-Fc/ΔHep and HA binding protein (HABP) to HA, heparin, and other GAGs were compared. For this experiment, biotinylated-TSG-6-LM-Fc and biotinylated-TSG-6-LM-Fc/ΔHep HA binding proteins were generated and compared to commercially available biotinylated-HA binding protein (HABP) (Seikagaku, Tokyo, Japan) for their binding activity on GAG chain coated plates.

A. Biotinylation of TSG-6-LM-Fc and TSG-6-LM-Fc/ΔHep

A random labeling approach was used to conjugate the biotin to primary amine containing residues (Lys) in the protein directly without pre-incubation with free HA in order to protect HA binding sites. For biotinylation of TSG-6-LM-Fc and TSG-6-LM-Fc/ΔHep, direct conjugation of the primary amine active reagent NHS-PEG$_4$-Biotin (Thermo Fisher Scientific, Chicago, Ill.) was performed according to the manufacturer's instructions. 0.5 mg protein in PBS at a concentration 1 mg/ml and 10 μl of 20 mM biotinylation reagent was used for the biotinylation reaction. The N-hydroxysuccinimide ester (NHS) group of NHS-PEG$_4$-Biotin reacts specifically and efficiently with lysine and N-terminal amino groups at pH 7-9 to form stable amide bonds. The hydrophilic polyethylene glycol (PEG) spacer arm imparts water solubility that is transferred to the biotinylated molecule, thus reducing aggregation of labeled proteins stored in solution. The PEG spacer arm also gives the reagent a long and flexible connection to minimize steric hindrance involved with binding to avidin molecules. Unreacted NHS-PEG$_4$-Biotin was removed with dialysis against 1×PBS and stored at −20° C.

For comparison, the TSG-6-LM-Fc and TSG-6-LM-Fc/ΔHep proteins also were biotinylated using the oriented labeling approach, which conjugates the biotin units to sugar chains on the proteins by oxidation of polysaccharide chain on the protein using NaIO$_4$ followed by biotin-hydrazide. Briefly, 1 ml protein at a concentration of 1 mg/ml in 0.1 M phosphate buffer, pH 7.2, was first oxidized by sodium periodate (NaIO$_4$) at a final concentration of 5 mg/ml, at 4° C. for 30 minutes. The reaction converts the two adjacent primary hydroxyl groups on sugars to corresponding aldehyde reactive groups. The oxidized protein was dialyzed against 0.1 M phosphate buffer, pH 7.2. The dialyzed protein was then mixed with 50 mM hydrazide-biotin prepared in DMSO at volume ratio 9 to 1 resulting in 5 mM hydrazide-biotin in the reaction and incubated at room temperature for 2 hours to form hydrazone bonds between aldehyde groups and hydrazide groups. The labeled protein was dialyzed against 1×PBS and stored at −20° C.

After conjugation and removal of free biotin, the HA binding activity of both biotin-TSG-6-LM-Fc and biotin-TSG-6-LM-Fc/ΔHep were tested together with non labeled corresponding proteins to examine if the labeling would cause reduced HA binding activity using the binding assay as described in Example 9A using HA coated plates. No difference in HA binding activity was found between labeled vs non labeled proteins.

B. Binding of biotinylated-TSG-6-LM-Fc, biotinylated-TSG-6-LM-Fc/ΔHep and biotinylated-HABP to GAGs For preparation of the GAG coated microplates, HA, Heparin, chondroitin sulfate A, or chondroitin sulfate C, at a concentration of 100 μg/ml in 0.5 M sodium carbonate buffer, were dispensed, 100 μl/well, into 96-well plates in duplicate, and incubated at 4° C. overnight. Plates were blocked with 1% BSA in PBS to reduce non-specific binding. The three biotinylated proteins, biotinylated-TSG-6-LM-Fc, biotinylated-TSG-6-LM-Fc/ΔHep and biotinylated-HABP were diluted to concentrations ranging from 0.05 to 100 ng/ml for binding to HA, chondroitin sulfate A, and chondroitin sulfate C coated plates, and 0.23 to 500 ng/ml for binding to heparin coated plates. The diluted protein samples were dispensed onto the plates, 100 μl/well in duplicate, and incubated at room temperature for 1 hour. The proteins bound to the GAG coated plates were detected with Streptavidin-HRP (Jackson ImmunoResearch, West Grove, Pa.) followed by TMB (3,3′,5,5′-tetramethylbenzidine) substrate (KPL, Gaithersburg, Md.) as described above. Absorbance was measured at OD450.

All three biotinylated GAG binding proteins exhibited strong HA binding activity on the HA coated plate. At 11.1 ng/ml protein concentration, which represented one dilution lower than maximal binding concentrations (i.e., 33.3 ng/ml and 100 ng/ml) for HA, binding of biotinylated-TSG-6-LM-Fc and biotinylated-TSG-6-LM-Fc/ΔHep to HA was approximately 14 fold over background, and B-HABP binding to HA was approximately 9 fold over background.

Both biotinylated-HABP and biotinylated-TSG-6-LM-Fc/ΔHep displayed little binding activity against the heparin coated plate. Biotinylated-wild type TSG-6-LM-Fc also showed negative in heparin binding activity, indicating that the random labeling approach with NHS-PEG$_4$-Biotin caused a loss of heparin binding activity. When TSG-6-LM-Fc was biotinylated by the oriented labeling approach as described above, binding to heparin was restored and the protein exhibited similar heparin binding activity as that of non-labeled TSG-6-LM-Fc. Thus, biotin modification of lysines in heparin site of TSG-6-LM-Fc may abolish its heparin binding activity.

All three proteins exhibited no binding activity to chondroitin sulfate C coated plate, but demonstrated strong binding towards chondroitin sulfate A coated plate. The biotinylated-TSG-6-LM-Fc and biotin-TSG-6-LM-Fc/ΔHep appeared to have a few fold higher binding activity than that of biotin-HABP. At 11.1 ng/ml protein concentration, binding of biotinylated-TSG-6-LM-Fc and biotinylated-TSG-6-LM-Fc/ΔHep to HA was approximately 20 fold and 12 fold over background, respectively and B-HABP binding to HA was approximately 6 fold over background. Nonetheless, both TSG-6-LM-Fc and TSG-6-LM-Fc/ΔHep have much stronger preference for binding to HA as demonstrated in the GAG competitive assay. As shown in Example 10, at least 10 fold more of chondroitin sulfate A was needed to reach the similar competitive inhibition as HA. In addition, in a separate experiment, biotinylated-HABP was compared to biotinylated-TSG-6-LM-Fc in a GAG competitive assay, and similar inhibition patterns of four GAG chains (HA, Heparin Chondroitin sulfates A & C) to the binding of biotin-HABP to HA versus the binding of TSG-6-LM-Fc to HA were observed.

Example 12

Quantitation of Hyaluronan in K$_3$-EDTA Human Plasma by Aggrecan Binding Assay

The concentration of hyaluronan was determined in clinical human plasma samples using a sandwich binding assay. Plasma samples were obtained from 19 subjects with solid tumor and various tumor types at advanced stage. In addition, plasma samples also were obtained from twenty (20) normal patients (obtained from BioReclamation, Hicksville, N.Y.). Baseline levels of HA were determined as follows.

Immulon 4HBX 96-well flat bottom microtiter plates (Immulon/Thermo; Catalog No. 3855) were coated with a recombinant human aggrecan (rHu-aggrecan) R & D Systems, Catalog No. 842162) as capture reagent. Prior to use, the rHu-aggrecan was reconstituted by adding 250 μl of reagent diluent to 1 vial and stored at 2-8° C. for up to 1 month. Then, to generate a 0.5 μg/mL solution of rHu-aggrecan, a 240-fold dilution of the stock was prepared (e.g., 41.7 μL stock to about 10 mL PBS). Immediately after dilution, 100 μL was dispensed into each well of a 4HBX plate and the plate was covered with a plate sealer and incubated overnight or up to 3 days at room temperature. After incubation, each well in the plate was washed five (5) times with 1×PBST wash buffer (1×PBS, 0.05% Tween 20) using the ELx405Select CW plate washer. The assay plate was then blocked with block buffer (5% Tween 20 in PBS) by adding 300 μL of block buffer to each well. The plate was covered with an adhesive plate cover and incubated at ambient temperature for at least 1 hour without shaking.

Prior to incubating the plate with sample, plasma samples and a standard curve were prepared. Briefly, plasma test samples were obtained and stored at ≤60° C. until analyses. Immediately prior to analyses, the test samples were thawed on wet ice and mixed briefly by vortexing just prior to dilution. Then, several serial dilutions of plasma test sample dilutions were prepared in order to ensure at least one sample dilution fell within the range of the calibration curve by dilution in Reagent Diluent (5% Tween-20 PBS solution, prepared by adding 6.5 mL Tween-20 (Sigma; Catalog No. P7949) to 123.5 mL Phosphate Buffered Saline (PBS; Celi-Gro; Catalog No. 21-031-CV)). To assess assay validity, two quality control samples also were diluted for assay. The controls were pooled human plasma collected in $K_3$-EDTA (pooled human $K_3$-EDTA plasma; "low quality control") and pooled human $K_3$-EDTA plasma spiked with exogenous hyaluronan (HA) ("high quality control"). The minimum required dilution (MRD) for human K3-EDTA plasma (used as a control) was 1:4. Dilutions were in polypropylene tubes (e.g., BioRad Titer tubes; BioRad, Catalog No. 223-9391) and were made to a total volume (sample and diluent) of 500 μl. Each dilution was mixed as it was prepared by brief pulse-vortexing. Pipets were changed in between each dilution.

For the standard curve, a hyaluronan stock (132 kD, 1800 ng/mL; R& D Systems, Catalog No. 842164) was diluted by serial dilution in reagent diluent (5% Tween 20 in PBS) to final concentrations of 500 ng/mL, 167 ng/mL, 55.6 ng/mL, 18.5 ng/mL, 6.2 ng/mL, 2.1 ng/mL, and 0.68 ng/mL. A blank well containing reagent diluent also was included in the standard.

Then, at the end of the block step, each well was washed five (5) times with 1×PBST wash buffer (1×PBS, 0.05% Tween 20) using the ELx405Select CW plate washer. The test samples, controls and standard curve were added to the coated and blocked plate by adding 100 μL of each in triplicate to wells of the plate. The plate was covered with an adhesive plate sealer and incubated at ambient temperature for approximately 2 hours. After incubation, each well was washed five (5) times with 1×PBST wash buffer (1×PBS, 0.05% Tween 20) using the ELx405Select CW plate washer.

To detect binding of HA to the coated rHu-aggrecan, a biotinylated rHuAggrecan detection reagent (72 μg/mL; R& D Systems, Catalog No. 842163) was added to the plate. First, 10 mL of a 0.3 μg/mL biotinylated-aggrecan solution was made by diluting the stock solution 240-fold in reagent diluent (5% Tween/PBS). Then, 100 μL of the detection reagent was added to each well. The plate was covered with an adhesive seal and incubated at ambient temperature for approximately 2 hours. Each well was washed five (5) times with 1×PBST wash buffer (1×PBS, 0.05% Tween 20) using the ELx405Select CW plate washer. Then, an Streptavidin-HRP (SA-HRP; R&D Systems, Catalog No. 890803) working solution was prepared in reagent diluent by diluting the stock 200-fold. Then, 100 μL of the dilute SA-HRP working solution was added to each well. The plate was covered with an adhesive seal and incubated at ambient temperature for approximately 20 minutes with shaking at 500 rpm. At the end of the SA-HRP incubation period, each well was washed five (5) times with 1×PBST wash buffer (1×PBS, 0.05% Tween 20) using the ELx405Select CW plate washer. Then, 100 μL of a TMB substrate (KPL; Catalog No. 52-00-03), which was equilibrated to ambient temperature protected from light, was added to each well and incubated at ambient temperature for 20 minutes with shaking at 500 rpm. Then, 100 μL of TMB stop solution (KPL; Catalog No. 50-85-06) was added to each well for at least 5 minutes but less than 30 minutes prior to determining the optical density at 450 nm (OD 450 nm) using a microtiter plate spectrophotometer and SoftMax Pro software.

Based on the OD 450 nm value, the concentration of intact hyaluronan for each sample was determined by interpolating from the standard curve. The results were multiplied by the sample dilution factor. The data was reported as the average of all values within the limits of quantitation of the calibration curve in ng/mL. The results are set forth in Tables 12 and 13. The results show that the median plasma HA in healthy humans was 0.015 μg/mL while in phase 1 subjects it was 0.06 μg/mL. This represented a statistically significant difference with a p<0.0001.

TABLE 12

Plasma HA from Subjects with Tumors

| Subject | Tumor Type | Age | Sex | Result (ng/mL) |
|---|---|---|---|---|
| Trial 101 | | | | |
| 1 | Histiocytoma | 86 | M | 44.1 |
| 2 | Colorectal | 62 | M | 32.8 |
| 3 | Rectal | 60 | M | 53.2 |
| 4 | Pancreatic | 57 | F | 59.8 |
| 5 | Bladder | 63 | M | 20.3 |
| 6 | Colon | 66 | F | 52.2 |
| 7 | Pancreatic | 63 | M | 19.5 |
| 8 | Carcinoid | 56 | M | 62.6 |
| 9 | Ovarian | 70 | F | 82.3 |
| 10 | Colon | 60 | F | 254.6 |
| 11 | Prostate | 78 | M | 61.2 |
| 12 | Non small cell lung cancer | 61 | F | 348.3 |
| 13 | Prostate | 71 | M | 30.4 |
| 14 | Prostate | 55 | M | 82.4 |
| Trial 102 | | | | |
| 15 | Ovarian | 55 | F | 67.3 |
| 16 | Esophageal | 71 | M | 88.6 |
| 17 | NSCLC | 65 | F | 59.7 |
| 18 | colon w/liver mets | 72 | F | 55.4 |
| 19 | colo-rectal | 62 | F | 207.8 |

TABLE 13

Plasma HA from Healthy Subjects

| Subject | Age | Sex | Result (ng/mL) |
|---|---|---|---|
| 1 | 45 | M | 15.1 |
| 2 | 44 | M | 25.4 |
| 3 | 43 | M | 11.2 |
| 4 | 31 | M | 18.3 |
| 5 | 47 | M | 63.2 |
| 6 | 26 | F | 17 |
| 7 | 28 | F | 13.4 |

TABLE 13-continued

Plasma HA from Healthy Subjects

| Subject | Age | Sex | Result (ng/mL) |
|---|---|---|---|
| 8 | 21 | F | 13.4 |
| 9 | 41 | F | 12.8 |
| 10 | 24 | F | 12.6 |
| 11 | 19 | F | 7.6 |
| 12 | 33 | F | 18.4 |
| 13 | 28 | F | 18.5 |
| 14 | 21 | F | 14.5 |
| 15 | 35 | F | 19 |
| 16 | 54 | M | 11.7 |
| 17 | 37 | M | 21.9 |

TABLE 13-continued

Plasma HA from Healthy Subjects

| Subject | Age | Sex | Result (ng/mL) |
|---|---|---|---|
| 18 | 38 | M | 8.3 |
| 19 | 58 | M | 37.5 |
| 20 | 49 | M | 8.6 |

Example 13

Histochemical Detection of HA

Samples for histochemical detection of HA were obtained from a pre-biopsy tumor specimen and a post-treatment metastatic liver biopsy sample from a patient dosed for 4 weeks with 1.6 µg/kg PEGPH20+dexamethasone (see e.g., International PCT Publication No. WO2012/012300, which describes combination therapy of PEGPH20 with corticosteroid (e.g., dexamethasone) co-treatment). The pre-dose biopsy (pre biopsy) was an archived sample obtained in 2007 (3.5 years prior to the treatment with PEGPH20). The post-treatment biopsy sample was obtained 3 days after the last dose (8$^{th}$ dose) in a PEGPH20 plus dexamethasone treatment regimine from a female colon cancer patient with liver metastases. Specifically, the patient post-treatment biopsy was obtained after one cycle of PEGPH20 treatment at 1.6 µg/kg on a twice weekly schedule for the cycle of administration with dexamethasone co-treatment. The treatment cycle was defined as a 28-day period, with PEGPH20 administered intravenously (IV) and dexamethasone administered orally. On each dosing day, a premedication regimen of 4 mg of dexamethasone was administered orally one hour prior to the PEGPH20, followed by a second dose of 4 mg dexamethasone 8-12 hours after PEGPH20 dosing.

Briefly, the tumor biopsies were fixed in normal buffered formalin (NBF) and 5 µm sections cut and stained using a biotin labeled hyaluronan binding protein (HABP-bio) (Seikagaku, Japan). After washing to remove the primary reagent, a labeled secondary reagent was used. Nuclei were counter-stained using a DAPI (4',6-diamidino-2-phenylindole) reagent. Micrographs were captured via a Nikon Eclipse TE2000U inverted fluorescent microscope coupled to a Insight FireWire digital camera (Diagnostic Instruments, Michigan) or ZEISS overhead scope (Carl Zeiss, Inc.) that has the same imaging system.

The histochemical staining of the samples with biotinylated-HA binding protein demonstrated a decrease in pericellular and stromal HA levels after one cycle of PEGPH20 treatment. The results are summarized in Table 14. The H score represents the relative intensity of pericellular and stromal HA. The data demonstrates the ability of PEGPH20 to degrade tumor-associated HA as demonstrated by a reduction of HA staining in the tumor biopsy after treatment.

TABLE 14

Histochemical Detection of HA

| Specimen | Pericellular tumor cells (% cells stained) | | | | | Stroma (% area stained) | | | | | % total area | |
|---|---|---|---|---|---|---|---|---|---|---|---|---|
| | 3+ | 2+ | 1+ | 0 | H | 3+ | 2+ | 1+ | 0 | H | Tumor | Stroma** |
| prebiopsy | 10 | 30 | 25 | 35 | 115 | 30 | 50 | 15 | 5 | 205 | 40 | 50 |
| postbiopsy | 0 | 0 | 25 | 75 | 25 | 30 | 30 | 23 | 17 | 173 | 20 | 5 |

**tumor associated stroma

Example 14

TSG-6-Fc Tumor-Targeted Imaging for HA-Rich Cancer Diagnosis and Treatment

Hyaluronan-rich tumor-bearing mice or control mice were administered with TSG-6-LM-Fc/ΔHep labeled with DyLight 755 Fluor Labeling reagent (TSG-6-LM-Fc/ΔHep$^{DL755}$), and mice were imaged to assess tumor-binding and distribution of TSG-6-LM-Fc/ΔHep $^{DL7355}$. Specificity also was assessed by comparing staining and distribution to an IgG$^{DL755}$ control.

For generation of BxPC3 peritibial tumor-bearing mice, mice were inoculated with BxPC-3 human pancreatic adenocarcinoma (ATCC CRL-1687) tumor cells subcutaneously (s.c., right hind leg) at 1×10$^7$ cells/0.1 mL. For generation of HA$^{+3}$Du145-Has2 and HA-DU145 tumor-bearing mice, mice were inoculated with both Du145-Has2 cells (generated as described below) and Du145 cells peritibially (intramuscular injection adjacent to the right tibia periosteum on either side) at 5×10$^6$/0.05 mL TSG-6-LM-Fc/ΔHep$^{DL755}$ was generated by fluorescently labeling TSG-6-LM-Fc/ΔHep (generated as described in Example 8) with DyLight 755 using the Thermo Scientific DyLight 755 Amine-Reactive Dye kit (Catalog No. 84538; Thermo Scientific, Rockford, Ill.) according to the manufacturers protocol.

A. Distribution of TSG-6-LM-Fc/ΔHep$^{DL755}$ with and without pretreatment with PEGPH20

Mice bearing an HA$^{+2}$BxPC3 peritibial tumor at about 18-20 mm in diameter were injected intravenously with 1 µg, 5 µg or 10 µg TSG-6-LM-Fc/ΔHep$^{DL755}$. In one group of mice, mice were pretreated with intravenous administration of PEGPH20 at 4.5 mg/kg three (3) hours prior to administration of TSG-6-LM-Fc/ΔHep$^{DL755}$.

A fluorescent whole body image system (IVIS Lumina XR, Caliper Life Sciences, Mountain View, Calif.) was used to track fluorescence in the animal. Selective excitation of DyLight755 was done using a D745 nm band-pass filter, and the emitted fluorescence was collected through a long-pass D800 nm filter. The 3 groups of mice (non-injected, TSG-6-LM-Fc/ΔHep$^{DL755}$, and PEGPH20+TSG-6-LM-Fc/ΔHep$^{DL755}$) were imaged at various timepoints post TSG-6-LM-Fc/ΔHep$^{DL755}$ (1 hours, 4 hours, day 1, day 2, day 3, day 4, day 5 and day 6). For imaging, non-injected control mice also were assessed. Fluorescent images were captured with a super cooled, high sensitivity, digital camera. Fluorescent images were later analyzed with Living Image (Caliper Life Sciences, Mountain View, Calif.).

The results show that by 1 hour and 4 hours after injection, TSG-6-LM-Fc/ΔHep$^{DL755}$ was detected as circulating in the blood stream, and also was detected as starting to bind to the tumor. The binding to the tumor was dose-dependent, with increased staining intensity observed with the 10 µg dose. Less tumor binding was detected by imaging in mice treated with PEGPH20 at all doses and time points. At later time points after injection (e.g., day 1 or day 2), liver binding also was detected, although this was less in the mice injected with the 1 µg low dose of TSG-6-LM-Fc/ΔHep$^{DL755}$. TSG-6-LM-Fc/ΔHep$^{DL755}$ reached peak levels between day 1 and 2 as assessed by image analysis. In low-dose treated mice, TSG-6-LM-Fc/ΔHep$^{DL755}$ was eliminated day 3 after injection. TSG-6-LM-Fc/ΔHep$^{DL755}$ was sill circulating in high-dose treated mice 5 days post injection, and all binding to the tumor was diminished 6 days after injection.

In sum, the in vivo imaging results show that TSG-6-LM-Fc/ΔHep$^{DL755}$ binding was dose-dependent and reached peaked levels 1-2 days post-injection. Further, HA removal by PEGPH20 resulted in less TSG-6-LM-Fc/ΔHep$^{DL755}$ binding. TSG-6-LM-Fc/ΔHep$^{DL755}$ binding was eliminated from the tumor 6 days post injection.

B. Comparison of TSG-6-LM-Fc/ΔHep$^{DL755}$ Binding Between Du145 Tumor+/−Has2

HA$^{+3}$Du145-Has2 and HA-DU145 tumor-bearing mice were injected intravenously with 5 µg TSG-6-LM-Fc/ΔHep$^{DL755}$. The mice were imaged daily post TSG-6-LM-Fc/ΔHep$^{DL755}$ injection. Although a low-level background staining of HA-DU145 tumor was detected, there was much more TSG-6-LM-Fc/ΔHep$^{DL755}$ binding to HA-rich Du145-Has2 as assessed by image results. The binding peaked at day 1-2 as determined by staining intensity. Thus, the results show that the more HA that is present in the tumor, the more TSG-6-LM-Fc/ΔHep$^{DL755}$ binds to the tumor.

C. Targeting Specificity of TSG-6-LM-Fc/ΔHep$^{DL755}$

The specificity of TSG-6-LM-Fc/ΔHep$^{DL755}$ for HA-rich tumors was further assessed by comparing binding of TSG-6-LM-Fc/ΔHep$^{DL755}$ or IgG$^{DL755}$ to HA$^{+2}$BxPC3 peritibial tumor-bearing mice. HA++BxPC3 peritibial tumor-bearing mice were injected intravenously with 5 µg TSG-6-LM-Fc/ΔHep$^{DL755}$ or with 5 µg IgG$^{DL755}$. The mice were imaged daily after injection. The imaging results showed little to no detectable staining of IgG$^{DL755}$ to the tumor, and thus greater binding of TSG-6-LM-Fc/ΔHep$^{DL755}$ to PC3 tumor than IgG$^{DL755}$.

Example 15

Assessment of Tumor Cell Hyaluronan (HA) Content, Levels of Hyaluronan Synthase (HAS), Hyaluronidase (Hyal) Expression and Pericellular Matrix Formation in Tumor Cells A. Cell Lines Used in the Study Ten cell lines from tumors of various tissue origin (e.g., prostate, breast, ovarian, pancreatic, and lung) and species origin (e.g., human, mouse and rat) were examined in the study. The following cell lines were obtained from the American Type Culture Collection (ATCC): 4T1 mouse breast tumor (ATCC CRL-2539), PC-3 human prostate adenocarcinoma (ATCC CRL-1435), BxPC-3 human pancreatic adenocarcinoma (ATCC CRL-1687), MDA MB 231 human breast adenocarcinoma (ATCC HTB-26), Mat-Lylu rat malignant prostate carcinoma (ATCC JHU-92), AsPc-1 human pancreatic adenocarcinoma (ATCC CRL-1682), DU-145 human prostate carcinoma (ATCC HTB-81), and MIA PaCa 2 human pancreatic carcinoma (ATCC CRL-1420). The ATCC cell lines were grown in recommended culture medium containing 10% FBS at 37° C. in a humidified incubator supplied with 5% $CO_2$/95% air. MDA-MB-231-Luc (Cat. No. D3H2LN) cells, which express the North American Firefly Luciferase gene, were purchased from Caliper Life Sciences Inc. and grown in RPMI containing 10% FBS.

The DU-145/HAS2 and MDA-MB-231-Luc/HAS2 cell lines were generated by transduction of the DU-145 and MDA-MB-231-Luc cell lines with a retrovirus encoding hyaluronan synthase 2 (HAS2) (SEQ ID NO:195). To generate the HAS2 retrovirus, N-terminal His6-tagged hHAS2 cDNA (SEQ ID NO:196) was inserted into the AvrII and NotI sites of the vector pLXRN (SEQ ID NO:197; Clontech, Cat. No. 631512), which includes the neomycin resistance gene, to create pLXRN-hHAS2 (SEQ ID NO:201). The pLXRN-hHAS2 His plasmid was then co-transfected with pVSV-G envelope vector (SEQ ID NO:198 Clontech, part of Cat. No. 631530) into GP-293 cells using Lipofectamine 2000 reagent (Life Technologies). A DU-145 Mock cell line also was generated by co-transfection of the empty pLXRN plasmid and pVSV-G envelope vector.

The virus titer was determined by quantitative PCR method (Retro-X™ qRT-PCR Titration Kit; Clontech, Catalog No. 631453) using the following primers (Clontech Catalog No. #K1060-E):

```
pLXSN 5' primer (1398-1420):
5'-CCCTTGAACCTCCTCGTTCGACC-3';    (SEQ ID NO: 199)

pLXSN 3' primer (1537-1515):
5'-GAGCCTGGGGACTTTCCACACCC-3'.    (SEQ ID NO: 200)
```

To establish HAS2 expression cell lines, 70% confluent cancer cells, DU-145 or MDA MB 231 Luc, were incubated with a 60:1 to 6:1 ratio of retrovirus in DMEM (Mediatech) containing 10% FBS for 72 hours. The cultures were maintained in selective medium containing 200 µg/mL of G418. Stable HAS2-expressing cancer cells were generated after 2 weeks of G418 conditional medium selection.

B. Quantification of Hyaluronic Acid

A hyaluronan binding protein (HABP)-based assay was employed to determine the amount of hyaluronan produced by the tumor cells. HABP-based assays are preferable to chemical methods for measuring HA as a tumor microenvironment (TME) biomarker because the HABP preferentially detects HA composed of at least 15 (n-acetyl glucose-glucuronic acid) disaccharides, which is competent to bind hyaladherins (HA binding proteins) (see, e.g., Haserodt S, et al. (2011) *Glycobiology* 21: 175-183).

Tumor cells were seeded at 1×10$^6$ cells in 75 cm$^2$ flasks and incubated for 24 hours. Tissue culture supernatants were harvested for quantitation of HA using an enzyme-linked HABP sandwich assay (R&D Systems, Catalog No. DY3614), which uses recombinant human aggrecan as an HA capture and detection reagent (recombinant human aggrecan G1-IGD-G2 domains, Val20-Gly676 of Accession No.

NP_037359 (SEQ ID NO:202) with a C-terminal 10-HIS tag, R&D Systems, Catalog No. 1220-PG). The assay for HA detection was performed according to the manufacturer's instructions. Briefly, assay plates were coated with recombinant human aggrecan, and samples (i.e., tissue culture supernatants) containing HA were added to the plate (three independent replicates of each cell line were tested). The plates were washed and the bound HA was detected using biotinylated recombinant human aggrecan. After removing the unbound probe, streptavidin conjugated to horseradish peroxidase (HRP) was added as a secondary detection reagent. After washing the plate, the bound HRP was detected by incubation with the 1:1 $H_2O_2$/Tetramethylbenzidine substrate solution (R&D Systems) and quantitated by optical density detection at 450 nm using a SpectraMax M3 Multi-Mode Microplate Reader (Molecular Devices, CA). Concentration of HA in the culture media for each tumor cell type was expressed as mean HA concentration (ng/mL) in culture media.

C. Quantification of HAS1, HAS2, HAS3, HYAL1 and HYAL2 mRNA Expression

RNA was extracted from cell pellets using an RNeasy® Mini Kit (Qiagen GmbH) according to the manufacturer's instructions. The extracted RNA was then quantified using a NanoDrop spectrophotometer (NanoDrop Technologies, Wilmington, Del.). Quantitative real-time PCR (qRT-PCR) using gene-specific primers was used to quantitate the relative mRNA levels of each hyaluronan synthase and hyaluronidase. qRT-PCR primers were purchased from Bio Applied Technologies Joint, Inc, (San Diego, Calif.). The DNA sequences for the primers used in the individual PCR reactions were as follows:

and relative values were plotted. Table 16 lists the CT values for each tumor cell type for each gene assayed.

D. Assay For Pericellular Matrix Formation

Monolayer cultures of the ten cell lines were grown and tested for aggrecan-facilitated pericellular matrix formation. To visualize aggrecan-mediated HA pericellular matrices in vitro, particle exclusion assays were used as previously described in Thompson C B, et al. (2010) *Mol Cancer Ther* 9: 3052-3064, with some modifications. Briefly, cells were seeded at $1 \times 10^5$ cells per well in a six-well plate for 24 hours, and then treated with culture cell media alone or media containing 1000 U/mL rHuPH20 (generated as described above) at 37° C. for 1 hour. Pre-treatment with rHuPH20 inhibits formation of the pericellular matrix; thus, it was employed as a negative control for pericellular matrix formation for each cell type. The cells were then incubated with 0.5 mg/mL of bovine aggrecan (Sigma-Aldrich) at 37° C. for 1 hour. Subsequently, media were removed and replaced with $10^8$/mL suspension of 2% glutaraldehyde-fixed mouse red blood cells (RBCs), isolated from Balb/c mouse (Taconic, Hudson, N.Y.), in PBS, pH 7.4. The particles were allowed to settle for 15 minutes. The cultures were then imaged with a phase-contrast microscope coupled with a camera scanner and imaging program (Diagnostic Instruments). Particle exclusion area and cell area were measured using the SPOT Advance program (Diagnostic Instruments, Inc., Sterling Heights, Mich.). Pericellular matrix area was calculated as matrix area minus cell area, and expressed as $\mu m^2$.

E. Results: Comparison of Tumor Cell HA Content, and HAS and HYAL Expression to Pericellular Matrix Formation The concentration of HA in conditioned media as determined by the HABP-based detection assay was found to

TABLE 15

Primer sequences used for qRT-PCR analysis of HAS and HYAL gene expression

| Gene | Forward primer | Reverse primer |
|---|---|---|
| HAS1 | 5'-TACAACCAGAAGTTCCTGGG-3' (SEQ ID NO: 395) | 5'-CTGGAGGTGTACTTGGTAGC-3' (SEQ ID NO: 396) |
| HAS2 | 5'-GTATCAGTTTGGTTTACAATC-3' (SEQ ID NO: 397) | 5'-GCACCATGTCATATTGTTGTC-3' (SEQ ID NO: 398) |
| HAS3 | 5'-CTTAAGGGTTGCTTGCTTGC-3' (SEQ ID NO: 399) | 5'-GTTCGTGGGAGATGAAGGAA-3' (SEQ ID NO: 400) |
| HYAL1 | 5'-GTGCTGCCCTATGTCCAGAT-3' (SEQ ID NO: 401) | 5'-ATTTTCCCAGCTCACCCAGA-3' (SEQ ID NO: 402) |
| HYAL2 | 5'-TCTACCATTGGCGAGAGTG-3' (SEQ ID NO: 403) | 5'-GCAGCCGTGTCAGGTAAT-3' (SEQ ID NO: 404) |
| GAPDH | 5'-TGCACCACCAACTGCTTAGC-3' (SEQ ID NO: 405) | 5'-GGCATGGACTGTGGTCATGAG-3' (SEQ ID NO: 406) |

For the PCR reactions, samples were mixed with iQ SYBR Green master mix (Bio-Rad) and the designated primer pairs for each gene. The PCR reactions were performed on a Bio-Rad Chromo 4 qPCR device. First strand synthesis was performed under the following conditions: 42° C. for 2 minutes for the DNA elimination reaction, 42° C. for 15 minutes for reverse-transcription, and 3 minutes at 95° C. for inactivation of reverse-transcriptase. For amplification, 3 minutes initial denaturation at 95° C., 45 cycles of 15 seconds denaturation and 1 minute annealing extension at 58° C. were used. The gene expression CT value from each sample was calculated by normalizing with the internal housekeeping gene GAPDH correlate with the area of aggrecan-mediated pericellular matrix formed by the tumor cells in monolayer culture (Table 16, P<0.0029). Further, cell lines that were engineered to express hyaluronan synthase 2 (HAS2), DU-145/HAS2 and MDA-MB-231/HAS2, displayed increased HA production and enhanced pericellular matrix formation in vitro compared to the respective parental cell lines. In contrast, no correlation was found between pericellular matrix formation and relative levels of HAS 1, 2, or 3 or Hyal 1 or 2 mRNA expression. These findings indicate that the direct measurement of tumor cell-associated HA specifically provides a predictor for pericellular matrix formation.

TABLE 16

Quantitation of HA production, pericellular matrix formation, HAS and Hyal expression in tumor cell lines

| Tumor Cell Line | PM[1] | HA in CM[2] | HAS isoform mRNA[3] | | | Hyaluronidase isoform mRNA[4] | |
|---|---|---|---|---|---|---|---|
| | | | HAS1 | HAS2 | HAS3 | Hyal1 | Hyal2 |
| 4T1 | 1552.00 | 473.83 | NE | NE | NE | NE | NE |
| MDA-MB-231/HAS2 | 1088.55 | 372.20 | 2.48 | 19.90 | 0.09 | 0.14 | 0.53 |
| PC3 | 1072.20 | 294.45 | 1.41 | 0.34 | 6.32 | 0.14 | 1.19 |
| DU-145/HAS2 | 981.00 | 7417.00 | 1.08 | 7.81 | 0.65 | 0.34 | 1.04 |
| BxPC3 | 967.20 | 467.12 | 1.00 | 1.00 | 1.00 | 1.00 | 1.00 |
| MDA-MB-231 WT | 770.45 | 256.90 | 3.39 | 0.54 | 0.05 | 0.13 | 0.64 |
| MatLylu | 760.55 | 265.91 | NE | NE | NE | NE | NE |
| AsPC-1 | 524.20 | 66.47 | 1.87 | 1.65 | 1.28 | 0.81 | 1.91 |
| DU-145 WT | 252.10 | 41.79 | 1.01 | 0.03 | 1.51 | 0.17 | 0.70 |
| MIA PaCa-2 | 129.40 | 0.00 | 0.46 | 0.00 | 0.04 | 0.28 | 0.72 |
| Correlation Coefficient (Spearman P value) | — | 0.0029 | 0.23 | 0.34 | 0.71 | 0.66 | 0.36 |

NE: not evaluated
[1]Pericellular matrix area ($\mu m^3$) assessed via particle exclusion assay.
[2]Mean HA concentration (ng/mL) in culture media (n = 3, independent cultures).
[3,4]Hyaluronan synthase (HAS) and hyaluronidase (Hyal) expression as determined by real-time RT-PCR. Ct values were normalized by GAPDH mRNA and the fold differences are relative to BxPC3 expression.

Since modifications will be apparent to those of skill in the art, it is intended that this invention be limited only by the scope of the appended claims.

SEQUENCE LISTING (428 sequences)

SEQ ID NO: 1 - protein, 509 aa, Homo sapiens
  precursor human PH20
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 2 - protein, 474 aa, Homo sapiens
  mature human PH20, amino acid residues 36-509
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 3 - protein, 482 aa, Homo sapiens
  precursor soluble human PH20, amino acid residues 1-482
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 4 - protein, 447 aa, Homo sapiens [sequence omitted]

SEQ ID NO: 5 - protein, 446 aa, Homo sapiens
  mature soluble human PH20, amino acid residues 36-481
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 6 - protein, 445 aa, Homo sapiens
  mature soluble human PH20, amino acid residues 36-480
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 7 - protein, 444 aa, Homo sapiens
  mature soluble human PH20, amino acid residues 36-479
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 8 - protein, 443 aa, Homo sapiens
  mature soluble human PH20, amino acid residues 36-478
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 9 - protein, 442 aa, Homo sapiens
  mature soluble human PH20, amino acid residues 36-477
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 10 - protein, 450 aa, Bos taurus
  cow hyaluronidase-1 precursor
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 11 - protein, 553 aa, Bos taurus
  cow PH20 hyaluronidase precursor
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 12 - protein, 331 aa, Vespula vulgaris
  yellow jacket wasp hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 13 - protein, 340 aa, Vespula vulgaris
  yellow jacket wasp hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 14 - protein, 382 aa, Apis mellifera
  honey bee hyaluronidase precursor
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 15 - protein, 331 aa, Dolichovespula maculata
  white-face hornet hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 16 - protein, 367 aa, Polistes annularis
  paper wasp hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 17 - protein, 462 aa, Mus musculus
  mouse hyaluronidase-1
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 18 - protein, 473 aa, Mus musculus
  mouse hyaluronidase-2 precursor
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 19 - protein, 412 aa, Mus musculus
  mouse hyaluronidase-3 precursor
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 20 - protein, 435 aa, Sus scrofa
  pig hyaluronidase-1 precursor
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 21 - protein, 419 aa, Sus scrofa
  pig hyaluronidase-3 precursor
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 22 - protein, 449 aa, Rattus norvegicus
  rat hyaluronidase-1 precursor
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 23 - protein, 473 aa, Rattus norvegicus
  rat hyaluronidase-2 precursor
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 24 - protein, 412 aa, Rattus norvegicus
  rat hyaluronidase-3 precursor
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 25 - protein, 545 aa, Oryctolagus cuniculus
  rabbit hyaluronidase PH20 precursor
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 26 - protein, 476 aa, Ovis aries
  sheep hyaluronidase-2 precursor
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 27 - protein, 114 aa, Ovis aries
  sheep sperm membrane protein PH20 (partial sequence)
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 28 - protein, 414 aa, Pongo pygmaeus
  orangutan hyaluronidase-3 precursor
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 29 - protein, 510 aa, Macaca fascicularis
  cynomolgus monkey hyaluronidase PH20 precursor
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 30 - protein, 529 aa, Cavia porcellus
  guinea pig hyaluronidase PH20 precursor
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 31 - protein, 512 aa, Rattus norvegicus
  rat hyaluronidase PH20 precursor
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 32 - protein, 512 aa, Mus musculus
  mouse hyaluronidase PH20 precursor
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 33 - protein, 807 aa, Staphylococcus aureus
  Staphylococcus aureus subsp. aureus COL hyaluronate lyase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 34 - protein, 371 aa, Streptococcus pyogenes
  Streptococcus pyogenes bacteriophage H4489A hyaluronidase
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 35 - protein, 1628 aa, Clostridium perfringens
  Clostridium perfringens str. 13 hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 36 - protein, 435 aa, Homo sapiens
  human hyaluronidase-1 precursor
  SIGNAL (1)...(21): signal sequence
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 37 - protein, 473 aa, Homo sapiens
  human hyaluronidase-2 precursor
  SIGNAL (1)...(20): signal sequence
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 38 - protein, 417 aa, Homo sapiens
  human hyaluronidase-3 precursor
  SIGNAL (1)...(20): signal sequence
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39 - protein, 481 aa, Homo sapiens
  human hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 40 - protein, 467 aa, Homo sapiens
  precursor soluble human PH20, amino acid residues 1-467
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 41 - protein, 477 aa, Homo sapiens
  precursor soluble human PH20, amino acid residues 1-477
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 42 - protein, 478 aa, Homo sapiens
  precursor soluble human PH20, amino acid residues 1-478
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 43 - protein, 479 aa, Homo sapiens
  precursor soluble human PH20, amino acid residues 1-479
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 44 - protein, 480 aa, Homo sapiens
  precursor soluble human PH20, amino acid residues 1-480
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 45 - protein, 481 aa, Homo sapiens
  precursor soluble human PH20, amino acid residues 1-481
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 46 - protein, 483 aa, Homo sapiens
  precursor soluble human PH20, amino acid residues 1-483
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 47 - protein, 432 aa, Homo sapiens
  mature soluble human PH20, amino acid residues 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 48 - protein, 448 aa, Homo sapiens
  mature soluble human PH20, amino acid residues 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 49 - DNA, 1446 bp, Homo sapiens
  DNA encoding soluble human PH20 precursor
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 50 - protein, 509 aa, Homo sapiens
  precursor human PH20 variant P48A
  SIGNAL (1)...(35): signal sequence
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 51 - protein, 509 aa, Homo sapiens
  precursor human PH20 variant L499W
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 52 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 53 - protein, 186 aa, Mus musculus
  mouse dihydrofolate reductase protein
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 54 - protein, 6 aa, Artificial Sequence
  His tag
HHHHHH

SEQ ID NO: 55 - protein, 8 aa, Artificial Sequence
  Flag tag
DYKDDDDK

SEQ ID NO: 56 - DNA, 1449 bp, Homo sapiens
  PH20 mRNA sequence from 3D35M cells (contains c to a at base 1131)
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 57 - protein, 17 aa, Homo sapiens
  C-terminal peptide cleaved from soluble human PH20, amino acid residues 431-447
DAFKLPPMETEEPQIFY

SEQ ID NO: 58 - protein, 16 aa, Homo sapiens
  C-terminal peptide cleaved from soluble human PH20, amino acid residues 431-446
DAFKLPPMETEEPQIF

SEQ ID NO: 59 - protein, 15 aa, Homo sapiens
  C-terminal peptide cleaved from soluble human PH20, amino acid residues 431-445
DAFKLPPMETEEPQI

SEQ ID NO: 60 - protein, 14 aa, Homo sapiens
  C-terminal peptide cleaved from soluble human PH20, amino acid residues 431-444
DAFKLPPMETEEPQ

SEQ ID NO: 61 - protein, 13 aa, Homo sapiens
  C-terminal peptide cleaved from soluble human PH20, amino acid residues 431-443
DAFKLPPMETEEP

SEQ ID NO: 62 - protein, 12 aa, Homo sapiens
  C-terminal peptide cleaved from soluble human PH20, amino acid residues 431-442
DAFKLPPMETEE

SEQ ID NO: 63 - protein, 520 aa, Ovis aries
  sheep PH20
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 64 - protein, 474 aa, Bos taurus
  cow hyaluronidase PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 65 - protein, 517 aa, Ovis aries
  sheep PH20
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 66 - DNA, 1620 bp, Ovis aries
  DNA encoding sheep PH20
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 67 - protein, 793 aa, Arthrobacter sp.
  Arthrobacter sp. FB24 hyaluronate lyase
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 68 - protein, 557 aa, Bdellovibrio bacteriovorus
  Bdellovibrio bacteriovorus HD100 hypothetical hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 69 - protein, 813 aa, Propionibacterium acnes
  Propionibacterium acnes KPA171202 hyaluronate lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 70 - protein, 1072 aa, Streptococcus agalactiae
  Streptococcus agalactiae hyaluronate lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 71 - protein, 1072 aa, Streptococcus agalactiae
  Streptococcus agalactiae 18RS21 hyaluronate lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 72 - protein, 1081 aa, Streptococcus agalactiae
  Streptococcus agalactiae A909 hyaluronate lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 73 - protein, 984 aa, Streptococcus agalactiae
  Streptococcus agalactiae NEM316 hyaluronate lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 74 - protein, 807 aa, Staphylococcus aureus; identical to SEQ ID NO: 33
  Staphylococcus aureus subsp. aureus COL hyaluronate lyase

SEQ ID NO: 75 - protein, 420 aa, Staphylococcus aureus
  Staphylococcus aureus strain MRSA252 hyaluronate lyase 2
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 76 - protein, 806 aa, Staphylococcus aureus
  Staphylococcus aureus strain MRSA252 hyaluronate lyase 1
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 77 - protein, 815 aa, Staphylococcus aureus
  Staphylococcus aureus subsp. aureus MW2 hyaluronate lyase precursor
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 78 - protein, 807 aa, Staphylococcus aureus; identical to SEQ ID NO: 33
  Staphylococcus aureus subsp. aureus COL hyaluronate lyase

SEQ ID NO: 79 - protein, 809 aa, Staphylococcus aureus
  Staphylococcus aureus RF122 hyaluronate lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 80 - protein, 807 aa, Staphylococcus aureus
  Staphylococcus aureus RF122 hyaluronate lyase precursor
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 81 - protein, 807 aa, Staphylococcus aureus; identical to SEQ ID NO: 33
  Staphylococcus aureus subsp. aureus USA300_TCH1516 hyaluronate lyase

SEQ ID NO: 82 - protein, 1066 aa, Streptococcus pneumoniae
  Streptococcus pneumoniae hyaluronidase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 83 - protein, 1078 aa, Streptococcus pneumoniae
  Streptococcus pneumoniae strain ATCC BAA-255 / R6 hyaluronate lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 84 - protein, 1067 aa, Streptococcus pneumoniae
  Streptococcus pneumoniae serotype 2, strain D39 / NCTC 7466 hyaluronate lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 85 - protein, 805 aa, Streptococcus pyogenes
  Streptococcus pyogenes serotype M1, strain GAS extracellular hyaluronate lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 86 - protein, 780 aa, Streptococcus pyogenes
  Streptococcus pyogenes serotype M2, strain MGAS10270 hyaluronate lyase precursor
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 87 - protein, 868 aa, Streptococcus pyogenes
  Streptococcus pyogenes serotype M4, strain MGAS10750 hyaluronate lyase precursor
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 88 - protein, 828 aa, Streptococcus pyogenes
  Streptococcus pyogenes serotype M6, strain MGAS10394 hyaluronate lyase precursor
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 89 - protein, 556 aa, Streptococcus pyogenes
  Staphylococcus aureus subsp. aureus strain MRSA252 hyaluronan lyase 2
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 90 - protein, 635 aa, Streptococcus pyogenes
  Streptococcus pyogenes strain MGAS9429 hyaluronate lyase precursor
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 91 - protein, 828 aa, Streptococcus pyogenes
  Streptococcus pyogenes serotype M12, strain MGAS9429 hyaluronate lyase precursor
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 92 - protein, 828 aa, Streptococcus pyogenes
  Streptococcus pyogenes serotype M28, strain MGAS6180
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 93 - protein, 522 aa, Streptococcus suis
  Streptococcus suis 05ZYH33 hyaluronidase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 94 - protein, 1164 aa, Streptococcus suis
  Streptococcus suis hyaluronidase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 95 - protein, 1164 aa, Streptococcus suis
  Streptococcus suis ST3 hyaluronidase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 96 - protein, 802 aa, Vibrio fischeri
  Vibrio fischeri strain ATCC 700601/ES114 hyaluronate lyase precursor
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 97 - protein, 517 aa, Synechococcus sp.
  Synechococcus sp. RCC307 neutral invertase-like protein
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 98 - protein, 1021 aa, Proteus vulgaris
  Proteus vulgaris chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 99 - protein, 684 aa, Pedobacter heparinus
  Pedobacter heparinus DSM 2366 chondroitin AC lyase
PALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 100 - protein, 844 aa, Victivallis vadensis
  Victivallis vadensis ATCC BAA-548 chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 101 - protein, 510 aa, Pan troglodyte
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 102 - protein, 512 aa, Macaca mulatta
  Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 103 - protein, 505 aa, Homo sapiens
  precursor soluble human PH20, amino acid residues 1-505
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 104 - protein, 503 aa, Homo sapiens
  precursor soluble human PH20, amino acid residues 1-503
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 105 - protein, 501 aa, Homo sapiens
  precursor soluble human PH20, amino acid residues 1-501
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 106 - protein, 499 aa, Homo sapiens
  precursor soluble human PH20, amino acid residues 1-499
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 107 - protein, 497 aa, Homo sapiens
  precursor soluble human PH20, amino acid residues 1-497
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 108 - protein, 495 aa, Homo sapiens
  precursor soluble human PH20, amino acid residues 1-495
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 109 - protein, 493 aa, Homo sapiens
  precursor soluble human PH20, amino acid residues 1-493
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 110 - protein, 491 aa, Homo sapiens
  precursor soluble human PH20, amino acid residues 1-491
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 111 - protein, 489 aa, Homo sapiens
  precursor soluble human PH20, amino acid residues 1-489
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 112 - protein, 490 aa, Homo sapiens
  precursor soluble human PH20, amino acid residues 1-490
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 113 - protein, 487 aa, Homo sapiens
  precursor soluble human PH20, amino acid residues 1-487
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 114 - protein, 485 aa, Homo sapiens
  precursor soluble human PH20, amino acid residues 1-485
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 115 - protein, 484 aa, Homo sapiens
  precursor soluble human PH20, amino acid residues 1-484
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 116 - protein, 476 aa, Homo sapiens
  precursor soluble human PH20, amino acid residues 1-476
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 117 - protein, 475 aa, Homo sapiens
  precursor soluble human PH20, amino acid residues 1-475
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 118 - protein, 474 aa, Homo sapiens
  precursor soluble human PH20, amino acid residues 1-474
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 119 - protein, 473 aa, Homo sapiens
  precursor soluble human PH20, amino acid residues 1-473
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 120 - protein, 472 aa, Homo sapiens
  precursor soluble human PH20, amino acid residues 1-472
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 121 - protein, 471 aa, Homo sapiens
  precursor soluble human PH20, amino acid residues 1-471
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 122 - protein, 470 aa, Homo sapiens
  precursor soluble human PH20, amino acid residues 1-470
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 123 - protein, 469 aa, Homo sapiens
  precursor soluble human PH20, amino acid residues 1-469
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 124 - protein, 468 aa, Homo sapiens
  precursor soluble human PH20, amino acid residues 1-468
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 125 - protein, 466 aa, Homo sapiens
  precursor soluble human PH20, amino acid residues 1-466
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 126 - protein, 465 aa, Homo sapiens
  precursor soluble human PH20, amino acid residues 1-465
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 127 - protein, 464 aa, Homo sapiens
  precursor soluble human PH20, amino acid residues 1-464
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 128 - protein, 462 aa, Homo sapiens
  precursor soluble human PH20, amino acid residues 1-462
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 129 - protein, 460 aa, Homo sapiens
  precursor soluble human PH20, amino acid residues 1-460
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 130 - protein, 458 aa, Homo sapiens
  precursor soluble human PH20, amino acid residues 1-458
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 131 - protein, 456 aa, Homo sapiens
  precursor soluble human PH20, amino acid residues 1-456
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 132 - protein, 454 aa, Homo sapiens
  precursor soluble human PH20, amino acid residues 1-454
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 133 - protein, 452 aa, Homo sapiens
  precursor soluble human PH20, amino acid residues 1-452
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 134 - protein, 450 aa, Homo sapiens
  precursor soluble human PH20, amino acid residues 1-450
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 135 - protein, 508 aa, Homo sapiens
  precursor soluble human PH20, amino acid residues 1-508
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 136 - protein, 506 aa, Homo sapiens
  precursor soluble human PH20, amino acid residues 1-506
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 137 - protein, 504 aa, Homo sapiens
  precursor soluble human PH20, amino acid residues 1-504
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 138 - protein, 502 aa, Homo sapiens
  precursor soluble human PH20, amino acid residues 1-502
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 139 - protein, 500 aa, Homo sapiens
  precursor soluble human PH20, amino acid residues 1-500
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 140 - protein, 498 aa, Homo sapiens
  HuPH20 precursor 1-498
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 141 - protein, 496 aa, Homo sapiens
  precursor soluble human PH20, amino acid residues 1-496
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 142 - protein, 494 aa, Homo sapiens
  precursor soluble human PH20, amino acid residues 1-494
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 143 - protein, 492 aa, Homo sapiens
  precursor soluble human PH20, amino acid residues 1-492
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 144 - protein, 488 aa, Homo sapiens
  precursor soluble human PH20, amino acid residues 1-488
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 145 - protein, 486 aa, Homo sapiens
  precursor soluble human PH20, amino acid residues 1-486
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 146 - protein, 472 aa, Homo sapiens
  mature soluble human PH20, amino acid residues 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 147 - protein, 470 aa, Homo sapiens
  mature soluble human PH20, amino acid residues 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 148 - protein, 468 aa, Homo sapiens
  mature soluble human PH20, amino acid residues 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 149 - protein, 466 aa, Homo sapiens
  mature soluble human PH20, amino acid residues 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 150 - protein, 464 aa, Homo sapiens
  mature soluble human PH20, amino acid residues 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 151 - protein, 462 aa, Homo sapiens
  mature soluble human PH20, amino acid residues 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 152 - protein, 460 aa, Homo sapiens
  mature soluble human PH20, amino acid residues 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 153 - protein, 458 aa, Homo sapiens
  mature soluble human PH20, amino acid residues 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 154 - protein, 456 aa, Homo sapiens
  mature soluble human PH20, amino acid residues 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 155 - protein, 454 aa, Homo sapiens
  mature soluble human PH20, amino acid residues 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 156 - protein, 455 aa, Homo sapiens
  mature soluble human PH20, amino acid residues 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 157 - protein, 452 aa, Homo sapiens
  mature soluble human PH20, amino acid residues 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 158 - protein, 450 aa, Homo sapiens
  mature soluble human PH20, amino acid residues 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 159 - protein, 449 aa, Homo sapiens
  mature soluble human PH20, amino acid residues 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 160 - protein, 441 aa, Homo sapiens
  mature soluble human PH20, amino acid residues 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 161 - protein, 440 aa, Homo sapiens
  mature soluble human PH20, amino acid residues 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 162 - protein, 439 aa, Homo sapiens
  mature soluble human PH20, amino acid residues 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 163 - protein, 438 aa, Homo sapiens
  mature soluble human PH20, amino acid residues 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 164 - protein, 437 aa, Homo sapiens
  mature soluble human PH20, amino acid residues 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 165 - protein, 436 aa, Homo sapiens
  mature soluble human PH20, amino acid residues 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 166 - protein, 435 aa, Homo sapiens
  mature soluble human PH20, amino acid residues 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 167 - protein, 434 aa, Homo sapiens
  mature soluble human PH20, amino acid residues 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 168 - protein, 433 aa, Homo sapiens
  mature soluble human PH20, amino acid residues 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 169 - protein, 431 aa, Homo sapiens
  mature soluble human PH20, amino acid residues 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 170 - protein, 430 aa, Homo sapiens
  mature soluble human PH20, amino acid residues 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 171 - protein, 429 aa, Homo sapiens
  mature soluble human PH20, amino acid residues 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 172 - protein, 427 aa, Homo sapiens
  mature soluble human PH20, amino acid residues 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 173 - protein, 425 aa, Homo sapiens
  mature soluble human PH20, amino acid residues 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 174 - protein, 423 aa, Homo sapiens
  mature soluble human PH20, amino acid residues 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 175 - protein, 421 aa, Homo sapiens
  mature soluble human PH20, amino acid residues 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 176 - protein, 419 aa, Homo sapiens
  mature soluble human PH20, amino acid residues 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 177 - protein, 417 aa, Homo sapiens
  mature soluble human PH20, amino acid residues 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 178 - protein, 415 aa, Homo sapiens
  mature soluble human PH20, amino acid residues 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 179 - protein, 473 aa, Homo sapiens
  mature soluble human PH20, amino acid residues 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 180 - protein, 471 aa, Homo sapiens
  mature soluble human PH20, amino acid residues 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 181 - protein, 469 aa, Homo sapiens
  mature soluble human PH20, amino acid residues 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 182 - protein, 467 aa, Homo sapiens
  mature soluble human PH20, amino acid residues 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 183 - protein, 465 aa, Homo sapiens
  mature soluble human PH20, amino acid residues 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 184 - protein, 463 aa, Homo sapiens
  mature soluble human PH20, amino acid residues 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 185 - protein, 461 aa, Homo sapiens
  mature soluble human PH20, amino acid residues 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 186 - protein, 459 aa, Homo sapiens
  mature soluble human PH20, amino acid residues 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 187 - protein, 457 aa, Homo sapiens
  mature soluble human PH20, amino acid residues 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 188 - protein, 453 aa, Homo sapiens
  mature soluble human PH20, amino acid residues 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 189 - protein, 451 aa, Homo sapiens
  mature soluble human PH20, amino acid residues 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 190 - DNA, 2105 bp, Bos taurus
  cow PH20 DNA
ggtttatctctgttcttggtgaggagacagacagaattgactgctgtgctcatccgcgagggtaaatgtgctcagctctttatggagtagtggagacgggcagagatgacaagatgaagcaacttgcaaaacattcctaaatacgaaggaagaagaatatttaaatgtaaatcatcattattcatttttatccatcaaagtggcttcattctgtgttcatatcttgcatcaaatattaggtacaccaaagcgtgtaggagaaaaaagtgcctttcacagtcatcgctctttgtgatgagaatgctgaggcgccaccatatctcctttcggagctttgctgggtctagcggaacaccccaggcagtgttcaccttccttctgcttccgtgttgtttggctctggacttcagagcaccccctcttatttcaaacacttctttcctctgggcctggaatgccccagttgaacgttgtgttaacagaagatttcaactacctccagatctgagactcttctctgtaaaaggaagcccccagaaaagtgctaccggacaatttattacattattttatgctgatagacttggctactatcctcatatagatgaaaaaacaggcaaaaccgtattcggaggaattccccagttgggaaacttaaaaagtcatatggagaaagcaaaaaatgacattgcctattacataccaaatgacagcgtgggcttggcggtcattgactgggaaaactggaggcctacctgggcaagaaactggaaacctaaagatgtttacagggatgagtcagttgagttggttctgcaaaaaaatccgcaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataatcataaccaacctacttacaatggaaattgccctgatgtagaaaaaaggagaaatgatgatctcgagtggttgtggaaggaaagcactgcccttttcccttctgtttatttgaatatcaggttaaaatctactcaaaatgctgccttgtatgttcgtaatcgtgtccaggaagccattcggttgtctaaaatagcgagtgtcgaaagtccacttccggtttttgtatatgcccgtccagtttttactgatgggtcttcaacatatctttctcagggtgaccttgtgaattcggttggtgagatcgtttctctaggtgcctctgggattataatgtggggcagtctcaatctaagcttatctatgcaatcttgcatgaacctaggcacttacttgaacactacactgaatccttacataatcaacgtcaccctagccgccaaaatgtgcagccaagtgctttgccacaatgaaggagtgtgtacaaggaaacactggaattcaagcgactatcttcacctgaacccaatgaattttgctattcaaactggggaaggtggaaaatacacagtacctgggacagtcacacttgaagacttgcaaaagttttctgatacattttattgcagttgttatgccaacatccactgtaagaagagagttgatataaaaaatgttcatagtgttaacgtgtgtatggcagaagacatttgtatagacagccctgtgaagttacaacccagtgatcattcctccagccaggaggcatctactaccaccttcagcagtatctcaccctccactacaactgccacagtatctccatgtactcctgagaaacactcccctgagtgcctcaaagtcaggtgttcggaagtcatccccaacgtcacccaaaaggcgtgtcaaagtgttaaattgaagaacatttcctatcagtcacctattcaaaatattaaaaatcaaacaacctattaaaattaaattcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaa

SEQ ID NO: 191 - DNA, 1971 bp, Bos taurus
  cow Hyal1 DNA
ttggtgcgcctggtgccagacttaaggaacagaatcttgctgatgcctgcacaggccctcgccctggggtcaggaagtttggagaatgaggcctttcagccttgaggtttccctacacctgccctgggctatggcagcccacttgcttcctgtctgcaccctgttcctgaacttgctcagcatgacccaaggctcccgggaccctgtggtccccaaccagcccttcactaccatctggaatgccaacaccgagtggtgtatgaagaaacacggcgtggacgtagacatcagtatctttgatgtggtgaccaacccggggcagaccttccgcggccctaacatgaccattttctacagctcccagctgggtacctacccttactatacatctgctggggagcctgtgtttggtggcctgccccagaatgccagcctgaatgcccacctggcccgcacattccaggacatcctggctgccatgcctgagcctcgcttctcagggctggcagtcattgactgggaggcatggcgcccgcgctgggccttcaactgggacaccaaggacatttaccggcagcgctcacgggcattggtacagaagcagcacccagactggctagctcctcgggtggaggccgcagctcaggaccagttcgagggggctgcagaggagtggatggcaggcaccctcaagctgggacaagcactgcgccctcagggcctctggggcttctataatttccctgagtgctacaactatgactttaaaagtcccaactatacaggccggtgtccactaaacatctgtgcccagaatgaccagctcgggtggctgtggggccagagccgtgccctctaccccagcatctacctgcctgcagcactggagggcacgaagaagacacagatgttcgtgcagcaccgtgtggctgaggcattccgtgtggcagcgggtgcgggggaccccaagctgccggtgctgccctacatgcagctcttctacgacatgactaaccactttctgcccgcggaggagctggagcacagcctgggggagagtgcagcccagggtgcagcgggagtggtgctctgggtgagctggctgagcacaagcaccaaggaatcatgccaggccatcaaggagtatgtggacacgacgctgggaccctccatcctgaatgtgaccagcggggctcgtctgtgcagtcaggtcctatgctccggccatggccgttgtgcccggcgccccagttaccccaaggcccgcctcatcctcaactccaccagtttttccatcaagcctacacctggtggtgggcccctgaccctacaaggtgccctctcgctcgaggatcggttgcggatggcagtggagttcgaatgtcgctgctaccgtgggtggagggggacacggtgtgagcagtggggcatgtggtgattggcatgggcacgcactgagtacctgatgcaagctgggcctggctaggtagggctttcccaagtccaggcagtcacaggagtcatggttacagtcagaagtccactcagccagtgtcatgagcatacaccagtgtgcacacctgcttacagaccaagatagctgcataaggacacggtgtgagcagtggggcatatgctgattggcatgggcacacactgagtacctgatgcaatctgggcctggctagggctttcccaagtccaggcagtcacaggagtcatggttaggcatccagtcacaggagtcatgtcaggcatcctgccgacagagtcaaaaatacttcctctggagacactgagtcagtcttcaaacagaagcagtcacaagcactgacattcgggacttccctggccatccagtggttaagacacggagcttccactgcagggggcacgggcagagactaagatcacgaatgctaagcggtgcggttaaacaaataacaaataaataaactgacattcactggg

SEQ ID NO: 192 - DNA, 1912 bp, Bos taurus
  cow Hyal2 DNA
caagtcgccggcgggctgcccaaagggcaggagctggcgcgaatagcttggctagagacttaccccgggaaggagggaggccgccgacctactgggccgacggactcccacacagttcctgagctggtgcctggcaggtgacactgacttcctgcagcccccagcatgtggacaggcctgggccccgccgtcacactggccctggtgttggtggtggcatgggccacggagctgaagcccacagcaccacccatcttcacgggccggccctttgtggtcgcatgggatgtgcccacacaggactgtggcccgcgccacaagatgccattggacccaaaggacatgaaggcctttgatgttcaggcttcacctaacgagggttttgtaaatcagaacatcaccatcttctaccgtgaccggctgggcatgtatccacacttcaattcggtggggaggtcagtacatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccatttggtagccattcgccaccctgattggccaccagagcgcgtagccaaggaggcgcagtatgagtttgagttcgctgcacggcagttcatgctggagacattgcgatttgtcaaggcgtttcggcctcggcacctatggggcttctacctcttccctgactgttacaaccatgattatgtgcagaactgggagacctatacaggccgctgccctgatgttgaggtctcccgaaatgaccagctggcctggctctgggccgagagcacggccctcttcccctctgtctacttggaagagacactggcttcctccactcacggccgcaactttgtcagctttcgtgtccaggaggctcttcgcgtggctgacgtccaccatgccaaccatgcactccccgtctacgtcttcacgaggcccacctatagccgtggactcacagggcttagcgagatggatctcatctccaccattggtgagagtgctgccctgggtgcagctggcgtcatcctctggggtgacgcagggtttaccaccagcaacgagacctgccgacgcctcaaggattatctgactcggtcattggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggaactcagttgggccgaccgcaaccacctacagatgcactttcgctgccagtgctacttaggctggggcggtgagcaatgccagtgggaccgcaggcgggcagctgggggtgccagtggggcctgggctgggtcccacctcactggcctgctggcagtggcagtcctggccttcacctagactttgtaagggtctctcacccagctgccacgccagctggcctctgccacaaggggtctgtcaggcatgtaggagcctgcaaggggtggacaaaccagagtctggaggggcagagccctctgggatgcctggtaggatgtccttaccagctcccaccccctgttctaagggggaggggcagtcccctggaaggccccgtctctccctgccagagaggaagaggggcacagctgggccggggaggacctgaccctactcccctgcccctggatagtttattattattattttggggtctcttttgtaaattaaatataaaacaact

SEQ ID NO: 193 - DNA, 1537 bp, Ovis aries
  sheep Hyal2 DNA
gcaaatgacactgacttcctgcagcccccagcatgtggacaggcctgggccccgccgtcacactggccctggtgttggtggtggcatgggccacagagctgaagcccacagcaccacccatcttcacgggccggccctttgtggttgcatgggatgtgcccacacaggactgtggcccacgccacaagatgccattggacccaaaggacatgaaggcctttgatgtgcaggcctcacctaacgagggttttgtaaatcagaacatcaccatcttctaccgtgaccggctgggcatgtatccacacttcaactcggtggggaggtcagtccatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccagttggtggccagtcaccaccccgattggccaccagagcgcatagtcaaggaggcgcagtatgagtttgagttcgctgcacggcagttcatgctggagacactgcgatttgtcaaggcgtttcggcctcggcacctatggggcttctacctcttccctgactgttacaaccatgattatgtgcaaaactgggagacctatacaggccgctgccctgatgttgaggtctcccgaaatgaccagctgtcctggctctgggccgagagcacagccctcttcccctctgtctacctggaagagacgctggcttcctccactcacggccgcaactttgtcagctttcgtgtccaggaggctcttcgcgtggctgacgtccaccatgccaaccatgcactcccagtctacgtcttcacgaggcccacctacagccgtggactcacagggcttagcgagatggatctcatctccaccattggtgagagtgctgccctgggtgcagccggcgtcatcctctggggtgacgcagggtttaccaccagcaacgagacctgccgacgcctcaaggattatctgactcggtcactggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggagctcagttgggccgaccgcaaccacctacagacgcactttcgctgccagtgctacttaggctggggcggtgagcagtgccagtgggaccgcaggcgggcagctgggggtgccagtggggcctgggctgggtcccacctcactggcctgctggcagtggcagtcctggccttcacctggacttcgtaagggtctcacccagctgccaggccagctggcctctgccacaaggggtctgccaggcatgtagcagcccacaaggg

SEQ ID NO: 194 - DNA, 1967 bp, Ovis aries
  sheep hyaluronidase DNA
actcctgtttatctctgttcttggtgaggagacagacagaattgactgctgtgctcatccaccaggttacagatgaagcaacttgcaaaacattcctaaatacgaaggaagaagagtatttaaacgtaaatcatcattattcatttttatccatcaaagtagcttcattctgtgttcctatcttgcatcaaatattaggtaaaccaaagtgtgtaggagaaaaaagtgcttttcatagtcatcgctctttgtgaagagaatgctaaggcgccgccatatctcctttaggagctttgttggggccagtggaacaccccaggcggcgctcgccttccttctgcttccatgttggttggctctggacttcagagcaccccctcttatttcaaacacttctttcctctgggcctggaatgccccagctgaacgttgtgttaaaatctttaaactacctccagatctgagactcttctctgtaaaaggaagcccccaaaaaagtgctacgggacaatttattacattattttatgctgatagacttggctactatcctcatatagatgaaaaaacaggcaacaccgtatatggaggaattccccagttgggaaacttaaaaaatcatttggaaaaagccaaaaaagacattgcctattatataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttccggtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttattaagaaaaaaaaaaaaaaaaaaaaaaaaaaaa

SEQ ID NO: 195 - protein, 552 aa, Homo sapiens
  human hyaluronan synthase 2 gi4885391
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 196 - DNA, 1849 bp, Artificial Sequence
  N-terminal His6-tagged hHAS2 cDNA
gtgcgaacgggcgtcttgtctgctgcagccaagcttgggctgcaggtcgacggatccgttaaccctagccaccatgcatcaccatcaccatcacggcggaggcggatcagggcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgagcggcctcgagagatcccctcaggatatagtagtttcgcttttgcatagggagggggaaatgtagtctatgcaattttttt

SEQ ID NO: 197 - DNA, 6419 bp, Artificial Sequence
  pLXRN
ttttgaaagaccccacccgtaggtggcaagctagcttaagtaacgccactttgcaaggcatggaaaaatacataactgagaatagaaaagttcagatcaaggtcaggaacaaagaaacagctgaataccaaacaggatatctgtggtaagcggttcctgccccggctcagggccaagaacagatgagacagctgagtgatgggccaaacaggatatctgtggtaagcagttcctgccccggctcggggccaagaacagatggtccccagatgcggtccagccctcagcagtttctagtgaatcatcagatgtttccagggtgccccaaggacctgaaaatgaccctgtaccttatttgaactaaccaatcagttcgcttctcgcttctgttcgcgcgcttccgctctccgagctcaataaaagagcccacaacccctcactcggcgcgccagtcttccgatagactgcgtcgcccgggtacccgtattcccaataaagcctcttgctgtttgcatccgaatcgtggtctcgctgttccttgggagggtctcctctgagtgattgactacccacgacgggggtctttcatttgggggctcgtccgggatttggagacccctgcccagggaccaccgacccaccaccgggaggtaagctggccagcaacttatctgtgtctgtccgattgtctagtgtctatgtttgatgttatgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagccaagcttgggctgcaggtcgacggatccgttaaccctaggctcgagagatcccctcaggatatagtagtttcgcttttgcatagggagggggaaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattccgcattgcagagatattgtatttaagtgcctagctcgatacagcaaacgccatttgaccattcaccacattggtgtgcacctccaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaaccctggccctattattgggtggactaaccatggggggaattgccgctggaataggaacagggactactgctctaatggccactcagcaattccagcagctccaagccgcagtacaggatgatctcagggaggttgaaaaatcaatctctaacctagaaaagtctctcacttccctgtctgaagttgtcctacagaatcgaaggggcctagacttgttatttctaaaagaaggagggctgtgtgctgctctaaaagaagaatgttgcttctatgcggaccacacaggactagtgagagacagcatggccaaattgagagagaggcttaatcagagacagaaactgtttgagtcaactcaaggatggtttgagggactgtttaacagatccccttggtttaccaccttgatatctaccattatgggacccctcattgtactcctaatgattttgctcttcggaccctgcattcttaatcgattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaaagaattgctagcaattgctagcaattgctagcaattcataccagatcaccgaaaactgtcctccaaatgtgtccccctcacactcccaaattcgcgggcttctgcctcttagaccactctaccctattccccacactcaccggagccaaagccgcggcccttccgtttctttgc

SEQ ID NO: 198 - DNA, 6507 bp, Artificial Sequence
  pVSV-G envelope vector
gcggccgctctagagagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggtcgaccgatcctgagaacttcagggtgagtttggggacccttgattgttctttctttttcgctattgtaaaattcatgttatatggagggggcaaagttttcagggtgttgtttagaatgggaagatgtcccttgtatcaccatggaccctcatgataattttgtttctttcactttctactctgttgacaaccattgtctcctcttattttcttttcattttctgtaactttttcgttaaactttagcttgcatttgtaacgaatttttaaattcacttttgtttatttgtcagattgtaagtactttctctaatcacttttttttcaaggcaatcagggtatattatattgtacttcagcacagttttagagaacaattgttataattaaatgataaggtagaatatttctgcatataaattctggctggcgtggaaatattcttattggtagaaacaactacaccctggtcatcatcctgcctttctctttatggttacaatgatatacactgtttgagatgaggataaaatactctgagtccaaaccgggcccctctgctaaccatgttcatgccttcttctctttcctacagctcctgggcaacgtgctggttgttgtgctgtctcatcattttggcaaagaattcctcgacggatccctcgaggaattctgacactatgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccttacaagtcaaaatgcccaagagtcacaaggctattcaagcagacggttggatgtgtcatgcttccaaatgggtcactacttgtgatttccgctggtatggaccgaagtatataacacattccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagtaactcaaatcctgcacaacagattcttcatgtttggaccaaatcaacttgtgataccatgctcaaagaggcctcaattatatttgagtttttaatttttatgaaaaaaaaaaaaaaaaacggaattcctcgagggatccgtcgaggaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacggatcggccgcaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtg

SEQ ID NO: 199 - DNA, 23 bp, Artificial Sequence
  pLXSN 5' primer (1398-1420)
cccttgaacctcctcgttcgacc

SEQ ID NO: 200 - DNA, 23 bp, Artificial Sequence
  pLXSN 3' primer (1537-1515)
gagcctggggactttccacaccc

SEQ ID NO: 201 - DNA, 8092 bp, Artificial Sequence
  pLXRN-hHAS2
ttttgaaagaccccacccgtaggtggcaagctagcttaagtaacgccactttgcaaggcatggaaaaatacataactgagaatagaaaagttcagatcaaggtcaggaacaaagaaacagctgaataccaaacaggatatctgtggtaagcggttcctgccccggctcagggccaagaacagatgagacagctgagtgatgggccaaacaggatatctgtggtaagcagttcctgccccggctcggggccaagaacagatggtccccagatgcggtccagccctcagcagtttctagtgaatcatcagatgtttccagggtgccccaaggacctgaaaatgaccctgtaccttatttgaactaaccaatcagttcgcttctcgcttctgttcgcgcgcttccgctctccgagctcaataaaagagcccacaacccctcactcggcgcgccagtcttccgatagactgcgtcgcccgggtacccgtattcccaataaagcctcttgctgtttgcatccgaatcgtggtctcgctgttccttgggagggtctcctctgagtgattgactacccacgacgggggtctttcatttgggggctcgtccgggatttggagacccctgcccagggaccaccgacccaccaccgggaggtaagctggccagcaacttatctgtgtctgtccgattgtctagtgtctatgtttgatgttatgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagccaagcttgggctgcaggtcgacggatccgttaaccctagccaccatgcatcaccatcaccatcacggcggaggcggatcagggcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgagcggcctcgagagatcccctcaggatatagtagtttcgcttttgcatagggagggggaaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattccgcattgcagagatattgtatttaagtgcctagctcgatacagcaaacgccatttgaccattcaccacattggtgtgcacctccaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaaccctggccctattattgggtggactaaccatggggggaattgccgctggaataggaacagggactactgctctaatggccactcagcaattccagcagctccaagccgcagtacaggatgatctcagggaggttgaaaaatcaatctctaacctagaaaagtctctcacttccctgtctgaagttgtcctacagaatcgaaggggcctagacttgttatttctaaaagaaggagggctgtgtgctgctctaaaagaagaatgttgcttctatgcggaccacacaggactagtgagagacagcatggccaaattgagagagaggcttaatcagagacagaaactgtttgagtcaactcaaggatggtttgagggactgtttaacagatccccttggtttaccaccttgatatctaccattatgggacccctcattgtactcctaatgattttgctcttcggaccctgcattcttaatcgattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcataccagatcaccgaaaactgtcctccaaatgtgtccccctcacactcccaaattcgcgggcttctgcctcttagaccactctaccctattccccacactcaccggagccaaagccgcggcccttccgtttctttgc

SEQ ID NO: 202 - protein, 657 aa, Homo sapiens
  recombinant human aggrecan G1-IGD-G2 domains, Val20-Gly676 of Accession No. NP_037359
VETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRG

SEQ ID NO: 203 - DNA, 669 bp, Homo sapiens
  cDNA fragment of human IgG1 heavy chain
acatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggccccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 204 - protein, 223 aa, Homo sapiens
  fragment of IgG1 heavy chain
TCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 205 - DNA, 1439 bp, Homo sapiens
  human Tumor necrosis factor-stimulated gene-6 (TSG-6) preprotein-encoding DNA GI No. 315139000
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacacaaaaaaaaaaaaaaaa

SEQ ID NO: 206 - protein, 277 aa, Homo sapiens
  human Tumor necrosis factor-stimulated gene-6 (TSG-6) preprotein, P98066
  SIGNAL (1)...(17): signal sequence
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 207 - protein, 95 aa, Homo sapiens
  human TSG-6 aa residues 35-129
AGVYHREARSGKYKLTYAEAKAVCEFEGGHLATYKQLEAARKIGFHVCAAGWMAKGRVGYPIVKPGPNCGFGKTGIIDYGIRLNRSERWDAYCYN

SEQ ID NO: 208 - DNA, 12 bp, Artificial Sequence
  12 bp sequence
gacaaaactcac

SEQ ID NO: 209 - protein, 4 aa, Artificial Sequence
  4 amino acid peptide
DKTH

SEQ ID NO: 210 - protein, 22 aa, Homo sapiens
  IgK signal peptide
MDMRVPAQLLGLLLLWLPGARG

SEQ ID NO: 211 - DNA, 1059 bp, Artificial Sequence
  TSG-6-LM-Fc fusion protein - Codon optimized DNA Seq. used for protein expression
gctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcaaaggccgtgtgcgagttcgaaggcggacacctggctacatataagcagctggaggccgctcgcaaaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcc

SEQ ID NO: 212 - protein, 349 aa, Artificial Sequence
  Peptide sequence for TSG-6-LM-Fc fusion protein
MRVPAQLLGLLLLWLPGARGADIAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGS

SEQ ID NO: 213 - DNA, 5540 bp, Artificial Sequence
  pHZ24-TSG-6-LM-Fc (DNA)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcaaaggccgtgtgcgagttcgaaggcggacacctggctacatataagcagctggaggccgctcgcaaaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcctagtaagaattcctcgagagatctatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacctgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataagtatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgag

SEQ ID NO: 214 - DNA, 1059 bp, Artificial Sequence
  TSG-6-LM-Fc/deltaHep (DNA)
gctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcagcggccgtgtgcgagttcgaaggcggacacctggctacatatgcgcagctggaggccgctcgcgcaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcc

SEQ ID NO: 215 - protein, 349 aa, Artificial Sequence
  TSG-6-LM-Fc/deltaHep (protein)
MRVPAQLLGLLLLWLPGARGADIAGVYHREARSGKYKLTYAEAAAVCEFEGGHLATYAQLEAARAIGFHVCAAGWMAKGRVGYPIVKPGPNCGFGKTGIIDYGIRLNRSERWDAYCYNTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGS

SEQ ID NO: 216 - DNA, 285 bp, Homo sapiens
  TSG-6 preprotein, DNA encoding aa 35-129 (285 bp)
gccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaac

SEQ ID NO: 217 - DNA, 1059 bp, Artificial Sequence
  TSG-6-LM-Fc fusion protein encoding DNA
gctagcatggacatgcgcgtacctgctcagttgttggggctcttgctgctgtggttgcccggggcacgtggggcagatatcgccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacaccggtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaggatcc

SEQ ID NO: 218 - DNA, 5540 bp, Artificial Sequence
  pHZ24-TSG-6-LM-Fc/deltaHep (DNA)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcagcggccgtgtgcgagttcgaaggcggacacctggctacatatgcgcagctggaggccgctcgcgcaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcctagtaagaattcctcgagagatctatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacctgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataagtatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgag

SEQ ID NO: 219 - DNA, 2116 bp, Homo sapiens
  HAS1 (DNA)
cggagagaagagagagcccggccagacccactgcgatgagacagcaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttcaaaaaaaaaaaaaaaaaaaaaaaaaaaaa

SEQ ID NO: 220 - DNA, 3275 bp, Homo sapiens
  HAS2 (DNA)
gaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttttaagacgaaaaagagattttctgttatcgggggcagaaagactgaagcccaaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtt

SEQ ID NO: 221 - DNA, 4220 bp, Homo sapiens
  HAS3 (DNA)
gagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaa

SEQ ID NO: 222 - protein, 260 aa, Homo sapiens
  mature human Tumor necrosis factor-stimulated gene-6 (TSG-6) protein P98066
WGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 223 - protein, 2570 aa, Homo sapiens
  Stabilin-1 protein Q9NY15
MAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICSNPNKHGEQCQEDCGCVHGLCDNRPGSGGVCQQGTCAPGFSGRFCNESMGDCGPTGLAQHCHLHARCVSQEGVARCRCLDGFEGDGFSCTPSNPCSHPDRGGCSENAECVPGSLGTHHCTCHKGWSGDGRVCVAIDECELDMRGGCHTDALCSYVGPGQSRCTCKLGFAGDGYQCSPIDPCRAGNGGCHGLATCRAVGGGQRVCTCPPGFGGDGFSCYGDIFRELEANAHFSIFYQWLKSAGITLPADRRVTALVPSEAAVRQLSPEDRAFWLQPRTLPNLVRAHFLQGALFEEELARLGGQEVATLNPTTRWEIRNISGRVWVQNASVDVADLLATNGVLHILSQVLLPPRGDVPGGQGLLQQLDLVPAFSLFRELLQHHGLVPQIEAATAYTIFVPTNRSLEAQGNSSHLDADTVRHHVVLGEALSMETLRKGGHRNSLLGPAHWIVFYNHSGQPEVNHVPLEGPMLEAPGRSLIGLSGVLTVGSSRCLHSHAEALREKCVNCTRRFRCTQGFQLQDTPRKSCVYRSGFSFSRGCSYTCAKKIQVPDCCPGFFGTLCEPCPGGLGGVCSGHGQCQDRFLGSGECHCHEGFHGTACEVCELGRYGPNCTGVCDCAHGLCQEGLQGDGSCVCNVGWQGLRCDQKITSPQCPRKCDPNANCVQDSAGASTCACAAGYSGNGIFCSEVDPCAHGHGGCSPHANCTKVAPGQRTCTCQDGYMGDGELCQEINSCLIHHGGCHIHAECIPTGPQQVSCSCREGYSGDGIRTCELLDPCSKNNGGCSPYATCKSTGDGQRTCTCDTAHTVGDGLTCRARVGLELLRDKHASFFSLRLLEYKELKGDGPFTIFVPHADLMSNLSQDELARIRAHRQLVFRYHVVGCRRLRSEDLLEQGYATALSGHPLRFSEREGSIYLNDFARVVSSDHEAVNGILHFIDRVLLPPEALHWEPDDAPIPRRNVTAAAQGFGYKIFSGLLKVAGLLPLLREASHRPFTMLWPTDAAFRALPPDRQAWLYHEDHRDKLAAILRGHMIRNVEALASDLPNLGPLRTMHGTPISFSCSRTRAGELMVGEDDARIVQRHLPFEGGLAYGIDQLLEPPGLGARCDHFETRPLRLNTCSICGLEPPCPEGSQEQGSPEACWRFYPKFWTSPPLHSLGLRSVWVHPSLWGRPQGLGRGCHRNCVTTTWKPSCCPGHYGSECQACPGGPSSPCSDRGVCMDGMSGSGQCLCRSGFAGTACELCAPGAFGPHCQACRCTVHGRCDEGLGGSGSCFCDEGWTGPRCEVQLELQPVCTPPCAPEAVCRAGNSCECSLGYEGDGRVCTVADLCQDGHGGCSEHANCSQVGTMVTCTCLPDYEGDGWSCRARNPCTDGHRGGCSEHANCLSTGLNTRRCECHAGYVGDGLQCLEESEPPVDRCLGQPPPCHSDAMCTDLHFQEKRAGVFHLQATSGPYGLNFSEAEAACEAQGAVLASFPQLSAAQQLGFHLCLMGWLANGSTAHPVVFPVADCGNGRVGIVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLSANASQGKLLPAHSGLSLIISDAGPDNSSWAPVAPGTVVVSRIIVWDIMAFNGIIHALASPLLAPPQPQAVLAPEAPPVAAGVGAVLAAGALLGLVAGALYLRARGKPMGFGFSAFQAEDDADDDFSPWQEGTNPTLVSVPNPVFGSDTFCEPFDDSLLEEDFPDTQRILTVK

SEQ ID NO: 224 - protein, 2551 aa, Homo sapiens
  Stabilin-2 protein Q8WWQ8
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 225 - protein, 862 aa, Homo sapiens
  CAB61358 protein
GTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKGSAGLFQQLSSRPCISRTPD

SEQ ID NO: 226 - protein, 768 aa, Homo sapiens
  KIAA0527 protein AB011099
PRVPQTGGGSLRPASYSPRLPAPSPSAPLYPQSARPSAAPFGTEVSRCPARRRSRVTAASSAPQRRPPGVRRPRRSGSASRASPGSPRSSLSARPARSLRFVSRAQSAEPSGARWAVAWATPNAARALTRVRWPAHSRTMTAEGPSPPARWHRRLPGLWAAALLLLGLPRLSVRADGKLFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGSPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTDGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGPVIATIVTVLCLLLLLAGVGMVWGYRKCQHKSSVYKLNVGQRQARHYHQQIEMEKV

SEQ ID NO: 227 - protein, 742 aa, Homo sapiens
  CD44 protein P16070
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 228 - protein, 322 aa, Homo sapiens
  Lymphatic vessel endothelial hyaluronic acid receptor 1 LYVE-1
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 229 - protein, 354 aa, Homo sapiens
  HAPLN1 Hyaluronan and proteoglycan link protein 1 P10915
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKILGYDRCDAGWLADGSVRYPISRPRRRCSPTEAAVRFVGFPDKKHKLYGVYCFRAYN

SEQ ID NO: 230 - protein, 340 aa, Homo sapiens
  HAPLN2 Hyaluronan and proteoglycan link protein 2 Q9CZV7
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 231 - protein, 360 aa, Homo sapiens
  HAPLN3 Hyaluronan and proteoglycan link protein 3 Q96S86
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 232 - protein, 402 aa, Homo sapiens
  HAPLN4 Hyaluronan and proteoglycan link protein 4 Q86UW8
MVCARAALGPGALWAAAWGVLLLTAPAGAQRGRKKVVHVLEGESGSVVVQTAPGQVVSHRGGTIVLPCRYHYEAAAHGHDGVRLKWTKVVDPLAFTDVFVALGPQHRAFGSYRGRAELQGDGPGDASLVLRNVTLQDYGRYECEVTNELEDDAGMVKLDLEGVVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDATRRLFGVYCYRAPGAPDPAPGGWGWGWAGGGGWAGGARDPAAWTPLHV

SEQ ID NO: 233 - protein, 2431 aa, Homo sapiens
  human Aggrecan protein P16112
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 234 - protein, 911 aa, Homo sapiens
  human Brevican protein Q96GW7
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 235 - protein, 2376 aa, Homo sapiens
  human Versican protein P13611
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 236 - protein, 1321 aa, Homo sapiens
  human Neurocan protein O15494
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 237 - protein, 2316 aa, Rattus norvegicus
  rat Phosphacan Q62656
MRILQSFLACVQLLCVCRLDWAYGYYRQQRKLVEEIGWSYTGALNQKNWGKKYPICNSPKQSPINIDEDLTQVNVNLKKLKFQGWEKPSLENTFIHNTGKTVEINLTNDYYLSGGLSEKVFKASKMTFHWGKCNVSSEGSEHSLEGQKFPLEMQIYCFDADRFSSFEETVKGKGRLRALSILFEIGVEENLDYKAIIDGTESVSRFGKQAALDPFILQNLLPNSTDKYYIYNGSLTSPPCTDTVEWIVFKDTVSISESQLAVFCEVLTMQQSGYVMLMDYLQNNFREQQYKFSRQVFSSYTGKEEIHEAVCSSEPENVQADPENYTSLLITWERPRVVYDTMIEKFAVLYQPLEGNDQTKHEFLTDGYQDLGAILNNLIPNMSYVLQIVAICSNGLYGKYSDQLIVDMPTEDAELDLFPELIGTEEIIKEENYGKGNEEDTGLNPGRDSATNQIRKKEPQVSTTTHYNHMGTKYNEAKTNRSPTRGSEFSGKSDVLNTSLNPTSQQVAEFNPEREMSLPSQIGTNLPPHSVEGTSASLNSGSKTLLVFPQMNLSGTAESLNMVSITEYKEVSADLSEEENLLTDFKLDSGADDSSGSSPASSTVPFSTDNLSHGYTSSSDTPEAVTYDVLRPESTRNALEDSAPSGSEESLKDPSLEGSVWFPGSTDLTTQSETGSGREGFLQVNSTDFQVDESRETTETFSPDATASRGPSVTDMEMPHYSTFAYPPTEVTSHAFTPSSRPLDLAPTSNILHSQTTQPVYNGETPLQPSYSSEVFPLVTPLLLDNQTLNTTPAASSSDSALHATPVFPSVGVSFDSILSSYDDAPLLPFSSASFSSDLFHHLHTVSQTLPQVTSAAERDELSLHASLLVAGGDLLLEPSLVQYSDVMSHQVTIHAASDTLEFGSESAVLYKTSMVSQIESPSSDVVMHAYSSGPETSYAIEGSHHVLTVSSSSAIPVHDSVGVADQGSLLINPSHISLPESSFITPTASLLQLPPALSGDGEWSGASSDSELLLPDTDGLRTLNMSSPVSVADFTYTTSVSGDDIKPLSKGEMMYGNETELKMSSFSDMAYPSKSTVVPKMSDIVNKWSESLKETSVSVSSINSVFTESLVYPITKVFDQEISRVPEIIFPVKPTHTASQASGDTWLKPGLSTNSEPALSDTASSEVSHPSTQPLLYEAASPFNTEALLQPSFPASDVDTLLKTALPSGPRDPVLTETPMVEQSSSSVSLPLASESASSKSTLHFTSVPVLNMSPSDVHPTSLQRLTVPHSREEYFEQGLLKSKSPQQVLPSLHSHDEFFQTAHLDISQAYPPKGRHAFATPILSINEPQNTLINRLVYSEDIFMHPEISITDKALTGLPTTVSDVLIATDHSVPLGSGPISMTTVSPNRDDSVTTTKLLLPSKATSKPTHSARSDADLVGGGEDGDDYDDDDYDDIDSDRFPVNKCMSCSPYRESQEKVMNDSDTQESSLVDQSDPISHLLSENTEEENGGTGVTRVDKSPDKSPPPSMLPQKHNDGREDRDIQMGSAVLPHTPGSKAWAVLTSDEESGSGQGTSDSLNDNETSTDFSFPDVNEKDADGVLEADDTGIAPGSPRSSTPSVTSGHSGVSNSSEAEASNSSHESRIGLAEGLESEKKAVIPLVIVSALTFICLVVLVGILIYWRKCFQTAHFYLEDNTSPRVISTPPTPIFPISDDIGAIPIKHFPKHVADLHASNGFTEEFETLKEFYQEVQSCTVDLGITADSSNHPDNKHKNRYVNIVAYDHSRVKLTQLAEKDGKLTDYINANYVDGYNRPKAYIAAQGPLKSTAEDFWRMIWEHNVEVIVMITNLVEKGRRKCDQYWPTDGSEEYGSFLVNQKNVQVLAYYTVRNFTLRNTKIKKGSQKGRSSGRLVTQYHYTQWPDMGVPEYSLPVLAFVRKTAQAKRHAVGPVVVHCSAGVGRTGTYIVLDSMLQQIQHEGTVNIFGFLKHIRSQRNYLVQTEEQYVFIHDTLVEAILSKETEVPDSHIHSYVNTLLIPGPSGKTKLEKQFQLLSQSNILQSDYSTALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMSEEHKCLSNEEKLIVQDFILEATQDDYVLEVRHFQCPKWPNPDSPISKTFELISIIKEEAANRDGPMIVHDEHGGVTAGTFCALTTLMHQLEKENSMDVYQVAKMINLMRPGVFTDIEQYQFLYKVVLSLVSTRQEENPSTSLDSNGAALPDGNIAESLESLV

SEQ ID NO: 238 - protein, 382 aa, Homo sapiens
  Layilin Isoform 1  Q6UX15
MRPGTALQAVLLAVLLVGLRAATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 239 - protein, 374 aa, Homo sapiens
  Layilin Isoform 2  NP_849156
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 240 - protein, 282 aa, Homo sapiens
  HABP1/C1QBP  Q07021
MLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 241 - protein, 12 aa, Homo sapiens
  PEP-1
GAHWQFNALTVR

SEQ ID NO: 242 - protein, 724 aa, Homo sapiens
  human Rhamm protein O75330
MSFPKAPLKRFNDPSGCAPSPGAYDVKTLEVLKGPVSFQKSQRFKQQKESKQNLNVDKDTTLPASARKVKSSESKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 243 - protein, 911 aa, Homo sapiens
  Inter alpha trypsin inhibitor heavy chain 1 P19827
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVSRDKICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 244 - protein, 946 aa, Homo sapiens
  Inter alpha trypsin inhibitor heavy chain 2 P19823
MKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 245 - protein, 890 aa, Homo sapiens
  Inter alpha trypsin inhibitor heavy chain 3 Q06033
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 246 - protein, 797 aa, Homo sapiens
  human SPACR protein Q17R60
MYLETRRAIFVFWIFLQVQGTKDISINIYHSETKDIDNPPRNETTESTEKMYKMSTMRRIFDLAKHRTKRSAFFPTGVKVCPQESMKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 247 - protein, 1241 aa, Homo sapiens
  human SPACRCAN protein Q9BZV3
MIMFPLFGKISLGILIFVLIEGDFPSLTAQTYLSIEEIQEPKSAVSFLLPEESTDLSLATKKKQPLDRRETERQWLIRRRRSILFPNGVKICPDESVAEAVANHVKYFKVRVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICRCRVGENWWYRGKHCEEFVSEPVIIGITIASVVGLLVIFSAIIYFFIRTLQAHHDRSERESPFSGSSRQPDSLSSIENAVKYNPVYESHRAGCEKYEGPYPQHPFYSSASGDVIGGLSREEIRQMYESSELSREEIQERMRVLELYANDPEFAAFVREQQVEEV

SEQ ID NO: 248 - protein, 300 aa, Homo sapiens
  human CD38 protein P28907
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 249 - protein, 413 aa, Homo sapiens
  Intracellular hyaluronan-binding protein 4  Q5JVS0
MKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAQRPDSPGGGLQAPGQKRTPRRGEQQGWNDSRGPEGMLERAERRSYREYRPYETERQADFTAEKFPDEKPGDRFDRDRPLRGRGGPRGGMRGRGRGGPGNRVFDAFDQRGKREFERYGGNDKIAVRTEDNMGGCGVRTWGSGKDTSDVEPTAPMEEPTVVEESQGTPEEESPAKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 250 - protein, 378 aa, Homo sapiens
  human CDC37 protein Q16543
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 251 - protein, 560 aa, Homo sapiens
  Hyaluronan-binding protein 2 PHBP  Q14520
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 252 - protein, 275 aa, Mus musculus
  Mouse TSG-6  O08859
MVVLLCLCVLLWEEAHGWGFKNGIFHNSIWLEQAAGVYHREARAGRYKLTYAEAKAVCEFEGGRLATYKQLEAARKIGFHVCAAGWMAKGRVGYPIVKPGPNCGFGKTGIIDYGIRLNRSERWDAYCYNPHAKECGGVFTDPKRIFKSPGFPNEYDDNQVCYWHIRLKYGQRIHLSFLDFDLEHDPGCLADYVEIYDSYDDVHGFVGRYCGDELPEDIISTGNVMTLKFLSDASVTAGGFQIKYVTVDPASKSSQAKNTSTTGNKKFLPGRFSHL

SEQ ID NO: 253 - protein, 276 aa, Oryctolagus cuniculus
  Rabbit TSG-6 P98065
MIILIYLFVLVWEEAQGWGFKNGIFHNSIWLEQAAGVYHREARSGKYKLTYAEAKAVCEFEGGRLATYKQLEAARKIGFHVCAAGWMAKGRVGYPIVKPGSNCGFGKTGIIDYGIRLNRSERWDAYCYNPHAKECGGVFTDPKRIFKSPGFPNEYDDNQICYWHIRLKYGQRIHLSFLNFDLEYDPGCLADYVEIYDSYDDVHGFVGRYCGDELPEDIISTGNVMTLKFLSDASVTAGGFQIKYVTVDPASKSSQGKNTSTVSGNKNFLAGRFSHL

SEQ ID NO: 254 - protein, 280 aa, Bos taurus
  Cow TSG-6  Q5W1C4
MIILIYLFVLLWEEAHGWGFKNGIFHNSIWLEQAAGVYHREARSGKYKLTYAEAKAVCEYEGGHLATYKQLEAARKIGFHVCAAGWMAKGRVGYPIVKPGPNCGFGKTGIIDYGIRLNRSERWDAYCYNPHAKECGGVFTDPKRIFKSPGFPNEYDDNQICYWHIRLKYGQRIHLSFLDFDLEDDPACLADYVEVYDSYDDVHGFVGRYCGDELPEDIISTGNVMTLKFLSDASVTAGGFQIKYVAVDPVSKSSQGKNASTTSTTSTGNKNFLAGRFSHL

SEQ ID NO: 255 - protein, 2571 aa, Mus musculus
  Mouse Stabilin-1  Q8R4Y4
MAEPRTLLLLCVLVLCLSDSSFIRGQTVRSKRCDIHTKFVTHTPCTACAAIRRQLCPWGWSRNFPEKILLDCRYELQLRGAAISLSGCSQECWKDVVQKACCPGYWGSQCFECPGGPATPCSGHGTCLDGIEGNGTCVCQGNFSGSVCQECRDPNRFGPDCQSVCNCVHGVCSHGPRGDGSCRCFAGYTGPHCDQELPVCQSLKCPQNSQCSAEAPTCKCLPGYTQQDNVCLAPDPCQPSACSPLARCSVTPQGQAQCQCPENYHGDGKVCLPRDPCLTNFGGCPSNSTFCLYRGPGKATCMCRPGMTSINNNASEGCHVSCKPHSCDRSATCQVTPDRKTSCVCKNDEVGDGHACYGHLLHEVRRANQNGLVFLRLRAAIAMLEQGCQEILTTSGPFTVLVPSMFSVSSVSSNMNATLAQQLCRQHVIAGEHMLENAGPPSTRRWWTLAGQEVTITFKNMRYAYKYEDQPQQFSIHKANYIAANGVFHTVTALRWQLPPPLPGDSKKTVGQILASTEVFTRFETILENCGLPSILDGPGPFTVFAPSNEAVDSLRDGRLIYLFTAGLSKLQELVRYHIYNHGQLTVEKLISKGRVLTMANQVLTVNISEGGRILLGPGGIPVRRVDVPAANGVIHMLEGILLPPTILPILPKHCDEEQHQTVLGSCVDCQALNTSVCPPNSVKMDIFPKECVYIHDPNGLNVLKKGCADYCNQTITKRGCCKGFFGPDCTQCPGGFSNPCYGKGNCSDGVRGNGACLCFPDYKGIACHICSDPKKHGEQCQEDCGCVHGLCDNRPGSGGVCQQGTCAPGFQGRFCNESMGNCGSTGLAQPCHSDAHCVIQEGVARCVCHDGFEGNGFSCKRSNPCSRPDRGGCSENAECVPGDLGTHHCICHKGWSGDGRICVAIDECGLDTRGGCHADALCSYVGPGQSRCTCKLGFAGNGYECSPIDPCRVGNGGCHGLATCKAVGGGQRVCTCPPHFGGDGFSCYGDIIQELEANAHFSAFSQWFKNSSITLPADSRVTALVPSESAIRRLSLEDQAFWLQPKMLPELARAHFLQGAFSEEELARLNGQQVATLSATTRWQIHNISGKVWVQNATVDVPDLLATNGILHIVSQVLLPPRGDMQTGPGLLQQLDSVPAFRLFGEQLKHHKLVAQIEAAKAYTIFVPTNHSLETQGNNSVLGIDTVRHHVILGEALSVEVLRKGGHRNSLLGPAHWLVFYNHSGQPEVNHMPLEGPLLEAPGSSLFGLSGILAVGSSRCLHSHAEALREKCINCTRKFRCTQGFQLQDTPRKSCVYRSGLSFSRGCSYTCAKKIQVPDCCPGFFGTLCEPCPGGLGGVCSGHGQCQDRFLGNGECRCQEGFHGTACEMCELGRYGPTCSGVCDCDHGLCQEGLRGNGSCVCHAGWQGLRCDQKITDHQCPKKCDPNANCIQDSAGIPACVCAAGYSGNGSYCSEVDPCASGHGGCSPYANCTKVAPGQRTCTCQDGYTGDGELCQEINSCLVHNGGCHVHAECIPTGPQQVSCSCREGYSGDGIQTCKLLDPCSQNNGGCSPYAVCKSTGDGQRTCSCDATHTVGDGITCHGRVGLELLRNKYASFFSLHLLEYKELKGDGPFTVFVPHADLISNMSQDELARIRAHRQLVFRYHVVGCRKLWSQEMLDQGYITTLSGHTLRVSEREGSIYLNDFARVVSSDLEVVNGVLHFIDHVLLPPDVLHWESGAIPIPQRNVTAAAESFGYKIFSRLLTVAGLLPMLQDASHRPFTMLWPTDSALQALPPDRKNWLFHEDHRDKLAAILRGHMIRNIEALASDLPNLGQLRTMHGNTISFSCGLTRPGELIVGEDEAHIVQRHLTFEGGLAYGIDQLLEPPDLGARCDRFEPQPLQMKTCSICGLEPPCPRGSREQGSPETCWRHYSKFWTTPLHSISMRGAYWIPSSFWNRNHMSRGCHRNCVTTVWKPSCCPGHYGINCHACPGGPRSPCSDHGVCLDGIRGSGQCNCHPGFAGTACELCAPGAFGPQCQACRCTQHGRCDEGLGGSGSCFCDEGWTGARCEVQLELQPVCTPPCAPQAVCRLGNSCECSLGYEGDGRVCTVADLCQKGHGGCSKHANCSQVGTVVTCTCLPDYEGDGWSCRARDPCLDGHRGGCSEHADCLNTGPNTRRCECHVGYVGDGLQCLEELEPPVDRCLGGSSPCHTDALCTDLHFQEKQAGVFHIQATSGPYGLTFSEAKEACEGQGAVLASLPQLSAAQQLGFHVCFVGWLANGSAAHPVVTPAADCGNNRVGVVSLGVRKNLSELWDAYCYRVQDVACQCRAGFVGDGISTCNGKLLDVLAATANFSTFYGMLLGYANATQRGLEFMDFLEDELTYKTLFVPVNKGFVDNMTLSGPDLELHASNATFLSINASRGTLLPAHSGLSLFISDTGPDNTSLVPLAPGAVVVSHVIVWDIMAFNGIIHALASPLLMPPQTRAVLGSEPPPVALSLGVVVTSGTLLGLVAGALYLRARGKPPGFSFSAFQAEDNADDDFSPWQEGTSPTLVSVPNPVFGSSDIFCEPFDDSVLEEDFPDTQRVLKVK

SEQ ID NO: 256 - protein, 2568 aa, Bos taurus
  Cow Stabilin-1  NP_001192499
MAGPRGHLLLCFLALCLAGPSFFGEQKVRSKRCDVKTKFVTHIPCTPCPAIKKRVCPLGWIRAFPEKISQDCRYEVQLGDSLLSMSGCSLECWKDMVQKACCPGYWGSQCYECPGGAETPCSGHGTCLDGLDGNGTCVCQENFSGSACQECRDPNRFGPDCQSVCRCVHGVCRHGPRGDGSCLCFAGYTGARCDQELLACQALNCPRNSQCSEEAPSCSCLPGYTQQGHECRASDPCRPSPCSPLAQCSVGPGGQAQCRCPENYHGDGTVCLPQDPCTTNNGGCPSNSTLCLYRKPGQASCLCKPGLVSIAHDSSAGCFAHCSAFSCDRSATCQVTPDGKTSCVCKEGEVGDGRACYGHLLHEVQKASQTSMLLRLRVTFAMLDQGCREILSTSGPFTVLAPLVSSRTMNASVAQQLCRQHIIAGQHMLEEAGTQAPRRWWTLAGQEITVSFSRFRKYTYKYQDQPQQTFTIHKANYPAANGLFHVVTALRLQPPPELPEDPKRTIGQILASNEVFSRFETILENCGLPSFLDGPGPFTVFAPSNEAVDGLRDGRLVYLFTAGLSKLQELVRYHVYNHGQLTVEKLLSKGRVLTMANQILAVNISEEGRILLGPEGVPLRRVDVLAANGVIHMLEGVLLPPTILPILPKLCNEEQHAVVAGSCVDCQALNTSTCPPNSVKLDISPEECVYIHDPTGLNVLKKGCAYYCNQTIQKPGCCKGFFGPDCLQCPGGFSNPCYGKGNCSDGVQGSGACLCFPDYKGIACHICSNPNKHGDQCQEDCGCVHGLCDNRPGSGGVCQHGTCAPGFSGRFCNESTVSCGSTEQAQQCHPHARCVNQGGVSRCLCLDGFEGDGFSCTPSDPCSRPDRGGCSENAECVPGVRGAHHCMCHKGWSGDGRVCVAVDECELDLRGGCHADALCSYVGPGQSRCTCKLGFAGDGYVCSPIDPCRAGNGGCHDLATCRAVGGGQRVCTCPPDYGGDGFSCYGDILKELEANAHFSVFYQWIKGAGITLPADSQVTALVPSESAIRRLSTEDQAFWLQPRLLPQLVRAHFLQGALSEEELARLHGQNVSTLNPTVRWEIHNVSGRVWVQNASVDVADLLATNGVLHVLSQVLLPPRRDVLGGQGLLQQLDSVPAFHLFRELLQRHRLVPQIEAATAYTIFVPTNHSLEAQANSSSLDSDVVRHHVILGEALSTEALGKGGHRNSLLGPAHWLVFYNHSGQPEVNHVPLEGPVLQAPGRSLFGLSGVLTVGSSRCLHSHAEALREKCVNCSRKFRCTQGYQLEDTPRKSCVYRSGYSFSRGCSYTCAKKIQVPDCCPGFFGTLCEPCPGGLGGVCSGHGQCQDRLLGSGECRCHEGFHGTACEMCELGRYGPNCTGVCDCAHGLCQEGLRGDGSCVCNVGWQGLRCDQKISGPQCLQKCDPNANCVQDSAAAPVCVCAAGYSGDGVSCSAVDPCARDHGGCSPHANCTTVAPGQRTCTCLDGYTGDGELCREANSCLIRHGGCHMHAECIPTGPQQVSCSCREGYSGDGIRACVLLDPCSQNNGGCSPYAVCKSTGDGQRTCACDAVRTVGDGFTCRARISLELLRDKHASFFSLHLLEYKDLKGDGPFTVFVPHADLLTNMSQDELARIRANRQLVFRYHVVGCRQLRSQELLEEGYATALSGHPLRFSEREGNIYINDFARVVSSDQEAVNGVLHFIDRVLLPPEVLHWEADAAPAPRRNFTAAAETFGYKIFSGLVTMAGLLPLLQDSSHRPLTMLWPTDSALQALPPDRQVWLYHKDHRDKLAAILRGHVIRNVEALASDLPNLGPLRTMHGTPISFSCSHARPGALTVGEDAARIVQRHLPFEGGLAYGIDQLLEPPGLGARCDRFETRPLWLKVCSICGLEPPCPPGSQEQGSPEACWRYFSKFWTSPPLHSLALRSVWTRPSHWGHPQGLGRGCYRNCVTTTWKPSCCPGHYGSECRACPGGASSPCNQRGSCMDGMSGSGECRCHTRFAGTACELCAPGAFGPLCQACNCTSHGRCDEGLGGSGSCFCDEGWTGPRCEVQLELQPVCAPPCAPQAVCRAGNSCECSLGYEGDGRTCTVVNLCQDGRGGCSEHANCSQAGTAVTCICWPDYEGDGWSCRARNPCEDGLRGGCSEHADCLNTGPNTRRCVCHAGYVGDGLQCLLEPEPPVDRCLDRPPPCHADAVCTDLHFQEKRAGVFHLQAPSGPYGLNFSEAEAACGAQGAVLASLLQLSAAQQLGLHLCLVGWLANGSAAHPVVFPAADCGDGQVGVVSLGARENLSERWDAYCFRMRDVACRCRDGFVGDGTSVCNGKLLDVLATTANFSIFYGMLLGYANATPRGLEFLDFLDDERTYKTLFVPVDEAFTDNTTLSGPDLELHASNTTFLSANASQGALLPAHSGLSLVIGNLGPGNSSRAPEVPGAVVVSRVIVWDILAFNGIIHTLASPLLAPPQAWAVVAPEAPPVAAGVGAVVAAGAVLGLVAGALYFRGRSRSAGFGFSAFQAEDAAADDFSPWQEGTSPPLVSVPNPVFGSHEAFCEPFDDSVLEEDFPDTQRILEVK

SEQ ID NO: 257 - protein, 2559 aa, Mus musculus
  Mouse Stabilin-2  Q8R4U0
MARSKLLLGKLLPLILIFLGLLVQNACSPTEAPELTKRCDKKSTLTIKTECQSCSVNIAVKCPDGYIKITNGTVGVRDCRYSLKIQSYVLDIPGCRHICRKDYLQPQCCPGHWGPDCMECPGGARAPCGGRGVCDEGMEGTGSCSCRAGFRGTACENCAAEDVFGPNCSAVCSCVHGVCNSGISGDGTCECLSAYRGPRCDKPIPECAALLCPENSRCSPSSKDETKLQCKCLPSYKGDGQTCKPINPCLKNVCHPHASCSYLGPNRHSCVCQKGYQGDGQVCLPVDPCQTSYGNCPTKSTVCRYDGPGQSHCECKEHYRNFVPGVGCSMTDICESKNPCHKNANCSTVSPGQTQCTCQKGYVGDGLNCYGNIMQRLRELNTEPRGMWQGQLTSFISILDRTYAWPLSNLGPFTVLLPSDKGLKGVDVKELLMDKEAARYFVKLHIIAGQMSTEQMYNLDTFYTLTGKSGEIINKDKDNQLKLKLYGSKIVQIIQGNIVASNGLVHILDRAMDKIEPTLESNPQQTIMTMLQPRYGKFRSLLEKTNVGQALEKGGIDEPYTIFVPSNEALSNMTAGVLDYLLSPEGSRKLLELVRYHIVAFTQLEVATLVSTLHIRSMANQIITFNISSKGQILANNVAVDETEVAAKNGRIYTLTGVLIPPSILPILPHRCNETKREMKLGTCVRCFMKNWSKCPTNSEPTAIFTNKCFYGSRAWNLKIGCARYCDVTVEIPRCCKGFFGPDCNPCPGGFMNPCSGNGQCIDGLGGNGTCICEDGFQGSRCQFCSKPNRYGPQCNRTCQCVHGICDNRLDSDGSCLPGTCREGTAGRFCDKQTSACGPYMQFCHIHATCEYSNETASCVCNDGYEGDGTLCSKKDPCLGSTSRGGCSPNAECIQASTGTYSCVCQRGWTGNGRDCVEINSCLLPSSGGCHDNATCLYVGPGQNECECKKGFRGNGIDCEPIISCLEQIEKCHPLATCQYTLSGVWSCVCQEGYEGNGVLCYGNVLMELSFLSEAAVFYQWINNASLQSMLSATSNLTVLVPSLQAIKDMDQNEKSFWLSRNNIPALIKYHTLLGTYRVADLQTLPSSHMLATSLQGSFLRLDKADGNITIEGASFVDGDNAATNGVVHIINKVLIPQRGLTGSLPSLLTRLEQMPDYSIFRGYIIHYNLASAIEAADAYTVFVPNNEAIESYIREKKATSLKEDILQYHVVLGEKLLRNDLHNGMHRETMLGFSYLLAFFLHNDQLYVNEAPINYTNVATDKGVIHGLEKVLEIKKNRCDNNDTIIVRGKCGKCSQQTLCPLETKPLSETRKCIYSVYFMGKRSIFIGCQLQCVRTIITSACCAGFFGPQCQACPGKGQNVCSGNGFCLDGVNGTGTCECEQGFNGTACETCTEGKYGIHCDQACSCVHGRCNQGPSGDGSCDCDVGWRGVKCDSEITTDNCNGTCHTSANCLLDPDGKASCKCAAGFQGNGTVCTAINACEISNGGCSAKADCKRTIPGSRVCVCKAGYTGDGIVCLEINPCLENHGGCDRHAECTQTGPNQAVCNCLPKYTGDGKVCTLINVCLTNNGGCSPFAFCNHTEQDQRTCTCKPDYTGDGIVCRGSIHSELPKNPSTSQYFFQLQEHAVQELAGPGPFTVFVPSSDSFNSESKLKVWDKQGLMSQILRYHVVACQQLLLENLKVITSATTLQGEPISISVSQDTVLINKKAKVLSSDIISTNGVIHVIDTLLSPQNLLITPKGASGRVLLNLTTVAANHGYTKFSKLIQDSGLLKVITDPMHTPVTLFWPTDKALQALPQEQQDFLFNEDNKDKLKAYLKFHVIRDTMALASDLPRSASWKTLQGSELSVRCGTGSDVGELFLNGQMCRIIQRRLLFDGGVAYGIDCLLMDPTEGGRCDTFTTFNIPGECGSCFSTPRCPLQSKPKGVRKKCIYNPLPFRRDVEGCQNLCTLVVHVPRCCSGYFMPDCQACPGGPDTPCNNRGMCYDQYKPTGQCQCHTGFNGTACELCLPGRFGPDCQPCGCSEHGQCDEGITGSGQCLCEAGWTGRFCDAPTVVIPVCIPACSMHATCMENNTCVCNLNYEGDGITCTVVDFCKQNNGGCAKVAKCSQKGTQVSCSCQKGYKGDGHSCTEIDPCANGVNGGCHEHATCRMTGPGKQKCECKSHYVGDGRDCEPEQLPLDRCLQDNGQCHPDANCVDLHFQDTTVGVFHLRSPLGQYKLTFDKAKEACAKEAASIATYNQLSYAQKAKYHLCSAGWLESGRVAYPTIYASKKCANIVGIVDYGTRTNKSEMWDVFCYRMKDVNCTCKAGYVGDGFSCNGNLLQVLMSFPSLTNFLTEVLVFSRSSAQGRAFLKHLTDLSISGTLFVPQNSGLPKNKSLSGRDIEHHLTNVNVSFYDDLVNGTVLKTRLGSQLLITSSQDQLHQEARFVDGRAILQWDIIASNGVLHIISEPLKAPPTAATAAHSGLGTGIFCAVVLVTGAIALAAYSYFRLNQRTTGFRRFESEDDIDALAFGKQQPESITNPLYETSTPAAPEPSCDPFTDSGERELENSDPLGALRS

SEQ ID NO: 258 - protein, 1431 aa, Rattus norvegicus
  Rat Stabilin-2  Q8CFM6
SLPSLLTRLEQMPDYSIFRGYIIHYNLASAIESADAYTVFVPNNEAIENYIREKKATSLKEDILRYHVVLGEKLLKNDLHNGMHRETMLGFSYLLAFFLRNDQLYVNEAPINYTNVATDKGVIHGLEKVLEIQKNRCDNNDTIIVRGECGKCSQQAPCPLETKPLRETRKCIYSIYFMGKRSVFIGCQPQCVRTIITRACCAGFFGPQCQACPGRGQNVCSGNGFCLDGVNGTGTCQCGLGFNGTACETCTEGKYGIHCDQACSCVHGRCSQGPLGDGSCDCDVGWRGVKCDMEITTDNCNGTCHTSANCLLDPDGKASCKCAAGFRGNGTVCTAINACETSNGGCSTKADCKRTTPGNRVCVCKAGYTGDGIVCLEINPCLENHGGCDRNAECTQTGPNQAVCNCLPKYTGDGKVCSLINVCLTNNGGCSPFAFCNYTEQDQRICTCKPDYTGDGIVCRGSIYGELPKNPSTSQYFFQLQEHAVRELAGPGPFTVFAPLSSSFNHEPRIKDWDQQGLMSQVLRYHVVGCQQLLLDNLKVTTSATTLQGEPVSISVSQDTVFINNEAKVLSSDIISTNGVIHVIDKLLSPKNLLITPKDALGRVLQNLTTVAANHGYTKFSKLIQDSGLLSVITDSIHTPVTVFWPTDKALEALPPEQQDFLFNQDNKDKLKSYLKFHVIRDSKALASDLPRSASWKTLQGSELSVRCGTGSDIGELFLNEQMCRFIHRGLLFDVGVAYGIDCLLMNPTLGGRCDTFTTFDIPGECGSCIFTPKCPLKSKPKGVKKKCIYNPLPFRRNVEGCQNLCTVVIQTPRCCHGYFMPDCQACPGGPDTPCNNRGMCRDLYTPMGQCLCHTGFNGTACELCWHGRFGPDCQPRSCSEHGQCDEGITGSGECLCETGWTAASCDTPTAVFAVCTPACSVHATCTENNTCVCNLNYEGDGITCTVVDFCKQNNGGCAKVAKCSQKGTQVSCSCKKGYKGDGYSCIEIDPCADGVNGGCHEHATCRMTGPGKHKCECKSHYVGDGVDCEPEQLPLDRCLQDNGQCHPDASCADLYFQDTTVGVFHLRSPLGQYKLTFDKAKEACAKEAATIATYNQLSYAQKAKYHLCSAGWLESGRVAYPTTYASQKCGANVVGIVDYGSRANKSEMWDVFCYRMKDVNCTCKAGYVGDGFSCSGNLLQVLMSFPSLTNFLTEVLAFSKSSARGQAFLKHLTDLSIRGTLFVPQNSGLPGNKSLSGRDIEHHLTNVNVSFYNDLVNGTFLRTMLGSQLLITFSQDQLHQETRFVDGRSILQWDIIAANGILHIISEPLRAPPTAATAAHSGLGTGIFCAVVLVTGAIALAAYSYFRLKQRTTGFQRFDQKRTLMSWLLASSSPRISQTLCMRPQRRHPQSPPVTPSQTLENRIWRTATLWGHCGPDMRSQQATTVTVPR

SEQ ID NO: 259 - protein, 778 aa, Mus musculus
  Mouse CD44  P15379
MDKFWWHTAWGLCLLQLSLAHQQIDLNVTCRYAGVFHVEKNGRYSISRTEAADLCQAFNSTLPTMDQMKLALSKGFETCRYGFIEGNVVIPRIHPNAICAANHTGVYILVTSNTSHYDTYCFNASAPPEEDCTSVTDLPNSFDGPVTITIVNRDGTRYSKKGEYRTHQEDIDASNIIDDDVSSGSTIEKSTPEGYILHTYLPTEQPTGDQDDSFFIRSTLATIASTVHSKSHAAAQKQNNWIWSWFGNSQSTTQTQEPTTSATTALMTTPETPPKRQEAQNWFSWLFQPSESKSHLHTTTKMPGTESNTNPTGWEPNEENEDETDTYPSFSGSGIDDDEDFISSTIATTPRVSARTEDNQDWTQWKPNHSNPEVLLQTTTRMADIDRISTSAHGENWTPEPQPPFNNHEYQDEEETPHATSTTPNSTAEAAATQQETWFQNGWQGKNPPTPSEDSHVTEGTTASAHNNHPSQRITTQSQEDVSWTDFFDPISHPMGQGHQTESKDTDSSHSTTLQPTAAPNTHLVEDLNRTGPLSVTTPQSHSQNFSTLHGEPEEDENYPTTSILPSSTKSSAKDARRGGSLPTDTTTSVEGYTFQYPDTMENGTLFPVTPAKTEVFGETEVTLATDSNVNVDGSLPGDRDSSKDSRGSSRTVTHGSELAGHSSANQDSGVTTTSGPMRRPQIPEWLIILASLLALALILAVCIAVNSRRRCGQKKKLVINGGNGTVEDRKPSELNGEASKSQEMVHLVNKEPSETPDQCMTADETRNLQSVDMKIGV

SEQ ID NO: 260 - protein, 503 aa, Rattus norvegicus
  Rat CD44  P26051
MDKVWWHTAWGLLCLLQLSLAQQQIDLNITCRYAGVFHVEKNGRYSISRTEAADLCEAFNTTLPTMAQMELALRKGFETCRYGFIEGHVVIPRIHPNAICAANNTGVYILLASNTSHYDTYCFNASAPLEEDCTSVTDLPNSFDGPVTITIVNRDGTRYSKKGEYRTHQEDIDASNIIDEDVSSGSTIEKSTPEGYILHTDLPTSQPTGDRDDAFFIGSTLATIATTPWVSAHTKQNQERTQWNPIHSNPEVLLQTTTRMTDIDRNSTSAHGENWTQEPQPPFNNHEYQDEEETPHATSTTWADPNSTTEEAATQKEKWFENEWQGKNPPTPSEDSHVTEGTTASAHNNHPSQRMTTQSQEDVSWTDFFDPISHPMGQGHQTESKGHSSGNQDSGVTTTSGPARRPQIPEWLIILASLLALALILAVCIAVNSRRRCGQKKKLVINSGNGTVEDRKPSELNGEASKSQEMVHLVNKEPTETPDQFMTADETRNLQSVDMKIGV

SEQ ID NO: 261 - protein, 366 aa, Bos taurus
  Cow CD44 Q29423
MDTFWWRAAWGLCLVQLSLAQIDLNITCRYAGVFHVEKNGRYSISKTEAADLCKAFNSTLPTMAQMEAARNIGFETCRYGFIEGHVVIPRIHPNSICAANNTGVYILTSNTSQYDTICFNASAPPGEDCTSVTDLPNAFEGPITITIVNRDGTRYTKKGEYRTNPEDINPSVVSPSSPPDDEMSSGSPSERSTSGGYSIFHTHLPTVHPSRPRRPWSQRAENTSDTRDYGSSHDPSGRSYTTHASESAGHSSGSEEHGANTTSGPMRKPQIPEWLIILASLLALALILAVCIAVNSRRRCGQKKKLVINNGNGTMEERKPSGLNGEASKSQEMVHLVNKGSSETPDQFMTADETRNLQNVDMKIGV

SEQ ID NO: 262 - protein, 351 aa, Canis lupus familiaris
  Dog CD44  Q28284
LAWGLCLLRLSLAQIDLNITCRYAGVFHVEKNGRYSISRTAAADLCKAFNSTLPTMAQMERALSVGFETCRYGFIEGHVVIPRIQPNAICAANHTGVYILISNTSQYDTYCFNASAPPEEDCTSVTHLPNAFDGPITITIVNRDGTRYSQKGEYRTNPEDINPSNPTDDDVSSGSSSERSTSAGYNIFHTHLPTAYPTEDQDSSRVSSNSDHTPITKDHDSSVHPSERSHTTHGSESAGHSSGSQEGGANTTSGPMRKPQIPEWLIILASLLALALILAVCIAVNSRRRCGQKKKLVINNGNGAVGDRKPSGINGEASKSQEMVHLVNKEPSETPDQYTTADETRNLQNVD

SEQ ID NO: 263 - protein, 359 aa, Equus caballus
  Horse CD44 Q05078
MDKFWWRAAWGLCLVPLSLAQIDLNITCRYAGVFHVEKNGRYSISRTEAADLCKAFNSTLPTMAQMQKALNIGFETCRIGFIEGHVVIPPIHPNSICAANNTGVYILTSNTSQYDTYCFNASAPPEEDCTSVTDLPNAFEGPITITIVNRDGTRYTKKGEYRTNPEDINPSTPADDDVSSGSSSERSTSGGYSIFHTHLPTTRPTQDQSSPWVSDSPEKTPTTKDRASGGRAQTTHGSETSGHSTGSQEGGASTTSGPIRRPQIPEWLIILASLLALALILAVCIAVNSRRRCGQKKKLVINNGNGAVDDRKASGLNGEASRSQEMVHLVNKESSETQDQFMTADETRNLQNVDMKIGV

SEQ ID NO: 264 - protein, 362 aa, Cricetulus griseus
  Hamster CD44  P20944
MDKFWWHAAWGLCLLPLSLAHEQIDLNITCRYAGVFHVEKNGRYSISRTEAADLCQAFNSTLPTMDQMVMALSKGFETCRYGFIEGHVVIPRIQPNAICAANHTGVYILTSNTSHYDTYCFNASAPLEEDCTSVTDLPNSFEGPVTITIVNRDGTRYSKKGEYRTHQEDIDASNTTDDDVSSGSSSEKSTSGGYVFHTYLPTIHSTADQDDPYFIGSTMATRDQDSSMDPRGNSLTVTDGSKLTEHSSGNQDSGLNSTSRPGGKPRVPEWLIVLASLLALALILAVCIAVNSRRRCGQKKKLVINSGNGKVEDRKPSELNGEASKSQEMVHLVNKEPSETPDQFMTADETRNLQNVDMKIGV

SEQ ID NO: 265 - protein, 362 aa, Papio hamadryas
  Baboon CD44 P14745
MDKFWWRAAWGLCLVQLSLAQIDLNITCRFEGIYHVEKNGRYSISRTEAADLCKAFNSTLPTMAQMEKALSIGFETCRYGFIEGHVVIPRIHPNSICAANNTGVYILTSNTSQYDTYCFNASAPPGEDCTSVTDLPNAFDGPITITIVNRDGTRYVKKGEYRTNPEDINPSSPTDDDVSSGSSSERSSTLGGYIFYNHFSTSPPIPDEDGPWITDSTDRTPATRDQGAFDPSGGSHTTHGSESAGHSHGSREGGANTTSGPLRTPQIPEWLIILASLLALALILAVCIAVNSRRRCGQKKKLVINNGNGAVEDRKSSGLNGEASKSQEMVHLVNKESSETPDQFMTADETRNLQNVDMKIGV

SEQ ID NO: 266 - protein, 431 aa, Mesocricetus auratus
  Golden Hamster CD44 Q60522
MDKFWWHAAWGLCLLPLSLAQQQIDLNITCRYAGVFHVEKNGRYSISRTEAADLCQAFNSTLPTMDQMVMALSKGFETCRYGFIEGHVVIPRIQPNAICAANHTGVYILTSNTSHYDTYCFNASAPLEEDCTSVTDLPNSFEGPVTITIVNRDGTRYSKKGEYRTHQEDIDASNTTDDDVSSGSSSEKSTSGGYVFHTYLPTIHSTADQDDPYFIGSTMATTRSGGKDGRRGGGLPKDATTSLEGYTTHYPETMENGTLTPVTPAKTGVFGETEVTVAEDSNFNVDGSLPGDQDSSMDPRGNSLTVTDGSKLTGHSSGNQDSGANTTSRPGRKPQIPEWLIVLASLLALALILAVCIAVNSRRRCGQKKKLVINSGNGKVEDRKPSELNGEASKSQEMVHLVNKEPSETPDQFMTADETRNLQNVDMKIGV

SEQ ID NO: 267 - protein, 318 aa, Mus musculus
  Mouse LYVE-1  Q8BHC0
MLQHTSLVLLLASIWTTRHPVQGADLVQDLSISTCRIMGVALVGRNKNPQMNFTEANEACKMLGLTLASRDQVESAQKSGFETCSYGWVGEQFSVIPRIFSNPRCGKNGKGVLIWNAPSSQKFKAYCHNSSDTWVNSCIPEIVTTFYPVLDTQTPATEFSVSSSAYLASSPDSTTPVSATTRAPPLTSMARKTKKICITEVYTEPITMATETEAFVASGAAFKNEAAGFGGVPTALLVLALLFFGAAAVLAVCYVKRYVKAFPFTTKNQQKEMIETKVVKEEKADDVNANEESKKTIKNPEEAKSPPKTTVRCLEAEV

SEQ ID NO: 268 - protein, 322 aa, Bos taurus
  Cow LYVE-1 Q6UC88
MAKFFSLGLLLASIWTTRLLVQGSLRSEEISILGPCRIMGVTLVTKKTQPLLNFTEAQEACRLVGLTLASQDQVEEARKFGFETCSYGWVKNQFVVIPRIISNPKCGKSGVGVVIWRSSLSSRHRSYCHNSSDIWINSCLPEIITTDDPLFNTETATYTTKLMVSDSTHSELSTDGPDYVTTTVAPPLASTSTPRKRKLICITEAFMDTSAVATERESDIQNRPAFKNEAVGFGGVPTALLVLALLFFAAAAGLAVCYVKRYVKAFPFTNKNQQKEMIETKVVKEEKADDSNPNEESKKMNKTPEEPKSPPKTTVRCLEAEV

SEQ ID NO: 269 - protein, 180 aa, Bos taurus
  Cow HAPLN1 A8E4P9
MKSLLLLVLISFCWADHHSDNYTVDHDRVIHIQAENGPRLLVEAEQAKVFSRRGGNVTLPCKFYRDPTAFGSGTHKIRIKWTKLTSDYLKEVDVFVSMGYHKKTYGGYHGRVFLKGGSDNDASLVITDLTLEDYGRYKCEVIEGLEDDTAVVALDLQGKYGVKLGMIINHCFFFMTSNVQ

SEQ ID NO: 270 - protein, 356 aa, Mus musculus
  MOUSE HAPLN1 Q9QUP5
MRSLLLLVLISVCWADHHLSDSYTPPDQDRVIHIQAENGPRLLVEAEQAKVFSHRGGNVTLPCKFYRDPTAFGSGIHKIRIKWTKLTSDYLREVDVFVSMGYHKKTYGGYQGRVFLKGGSDNDASLVITDLTLEDYGRYKCEVIEGLEDDTAVVALELQGVVFPYFPRLGRYNLNFHEARQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKLLGYDRCDAGWLADGSVRYPISRPRRRCSPTEAAVRFVGFPDKKHKLYGVYCFRAYN

SEQ ID NO: 271 - protein, 354 aa, Rattus norvegicus
  RAT HAPLN1 P03994
MRSLLFLVLISVCRADHLSDSYTPDQDRVIHIQAENGPRLLVEAEQAKVFSHRGGNVTLPCKFYRDPTAFGSGIHKIRIKWTKLTSDYLREVDVFVSMGYHKKTYGGYQGRVFLKGGSDNDASLIITDLTLEDYGRYKCEVIEGLEDDTAVVALELQGVVFPYFPRLGRYNLNFHEARQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKLLGYDRCDAGWLADGSVRYPISRPRRRCSPTEAAVRFVGFPDKKHKLYGVYCFRAYN

SEQ ID NO: 272 - protein, 355 aa, Gallus gallus
  CHICKEN HAPLN1 P07354
MTSLLFLVLISVCWAEPHPDNSSLEHERIIHIQEENGPRLLVVAEQAKIFSQRGGNVTLPCKFYHEHTSTAGSGTHKIRVKWTKLTSDYLKEVDVFVAMGHHRKSYGKYQGRVFLRESSENDASLIITNIMLEDYGRYKCEVIEGLEDDTAVVALNLEGVVFPYSPRLGRYNLNFHEAQQACLDQDSIIASFDQLYEAWRSGLDWCNAGWLSDGSVQYPITKPREPCGGKNTVPGVRNYGFWDKERSRYDVFCFTSNFNGRFYYLIHPTKLTYDEAVQACLKDGAQIAKVGQIFAAWKLLGYDRCDAGWLADGSVRYPISRPRKRCSPNEAAVRFVGFPDKKHKLYGVYCFRAYN

SEQ ID NO: 273 - protein, 354 aa, Bos taurus
  COW HAPLN1 P55252
MKSLLLLVLISFCWADHHSDNYTVDHDRVIHIQAENGPRLLVEAEQAKVFSRRGGNVTLPCKFYRDPTAFGSGTHKIRIKWTKLTSDYLKEVDVFVSMGYHKKTYGGYHGRVFLKGGSDNDASLVITDLTLEDYGRYKCEVIEGLEDDTAVVALDLQGVVFPYFPRLGRYNLNFHEAQQACLDQDAVIASFDQLYDAWRSGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKLLGYDRCDAGWLADGSVRYPISRPRRRCSPSEAAVRFVGFPDKKHKLYGVYCFRAYN

SEQ ID NO: 274 - protein, 354 aa, Equus caballus
  HORSE HAPLN1 28381
MKSLLLLVLISICGADHRSDNYTLDHDRVIHIQAENGPRLLVEAEQAKVFSHRGGNVTLPCKFLRDPTAFGSGTHKIRIKWTKLTSDYLKEVDVFVSMGYHKKTYGGYQGRVFLKGGSDNDASLVITDLTLDDYGRYKCEVIEGLEDDTAVVALDLQGVVFPYFPRLGRYNLNFHEAQQACLDQDAVIASFDQLYDAWRGGLDWCNAGWLSDGSVQYPITKPREPCGGQNTVPGVRNYGFWDKEKSRYDVFCFTSNFNGRFYYLIHPTKLTYDEAVQACLKDGAQIAKVGQIFAAWKLLGYDRCDAGWLADGSVRYPISRPRRRCSPTEAAVRFVGFPDKKHKLYGVYCFRAYN

SEQ ID NO: 275 - protein, 354 aa, Sus scrofa
  PIG HAPLN1 P10859
MKSLLLLVLISVCWADHLSNNYTLDHDRVIHIQAENGPRLLVEAEQAKVFSHRGGNVTLPCKFFRDPTAFGSGTHKIRIKWTKLTSDYLKEVDVFVSMGYHKKTYGGYHGRVFLKGGSDNDASLVITDLTLEDYGRYKCEVIEGLEDDTAVVALDLEGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKLLGYDRCDAGWLADGSVRYPISRPRRRCRPNEAAVRFVGFPDKKHKLYGVYCFRAYN

SEQ ID NO: 276 - protein, 341 aa, Mus musculus
  Mouse HAPLN2 Q9ESM3
MPSRIPLPAFCCFLLPWAFTSFHKALGNPAPHPGPHYLLPPIHEVIHSRRGATATLPCVLGTSPPSYKVRWSKVEPGELRETLILITNGLHARDYGLLGGRASLRRGHRLDASLIIKNVRLEDEGRYRCELINGIEDESVALTLRLEGVVFPYQPSRGRYQFNYFEAKRACEEQDGRLATYGQLYQAWTEGLDWCNAGWLLEGSVRYPVLTARAPCGGHGRPGIRSYGPRDRSRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQASYGTYCYAEK

SEQ ID NO: 277 - protein, 341 aa, Rattus norvegicus
  Rat HAPLN2 Q9ESM2
MPSWIPLPAFCCLLLPWAFTVFHKTLGNPAPHPGPHYLLPPIHEVIHSRRGATATLPCVLGTSPPSYKVRWSKVEPGELRETLILITNGLHARDYGLLGGRASLRRGHRLDASLIIKNVRLEDEGRYRCELINGIEDESVALTLRLEGVVFPYQPSRGRYQFNYFEAKRACEEQDGRLATYSQLYQAWTEGLDWCNAGWLLEGSVRYPVLNARAPCGGHGRPGIRSYGPRDRSRDRYDAFCFTSALAGQVFFVPGRLTLSEAHAVCRRRGAVVAKVGHLYAAWKFSGLDRCDGGWLADGSVRFPITTPRPRCGGLPDPGVRSFGFPRPQQAAYGTYCYAEK

SEQ ID NO: 278 - protein, 340 aa, Bos taurus
  Cow HAPLN2 NP_001069152
MQGRISLPTLCHFLLPWAFTTFHRALGSQAPHPGPHYLLPPIHEVIHSRRGATTTLPCVLGAPPPSYKVRWSKVEPGELRETPILITNGLHARGYGPLGGRARMRRGHRLDASLVIAGVRLEDEGRYRCELINGIEDESVAMTLRLEGVVFPYQPSRGRYQFNYYEAKQACEEQDGRLATYAQLYQAWTEGLDWCNAGWLLEGSVRYPVLTARAPCGGRGRPGIRSYGPRDRKRDRYDAFCFTSALSGHVFFVPGRLSLSEAHAACRRRGAMVAKVGHLYAAWKFSGLDQCDGGWLADGSVRFPITTPRPRCGGLPDPGVRSFGFPRPQQADYGTYCYSE

SEQ ID NO: 279 - protein, 359 aa, Mus musculus
  Mouse HAPLN3 Q80WM5
MSLLFLVLLSPFPCVLGLPFYNGFYYSNDLSGRTLGNGYGEGLFNGVKLVVETTEESLFSHQGASVTLPCHYHYEPALASPRHVRVKWWKLSENGAPEQDVLVVIGQRHRSFGDYQGRVQLRQDKQQEVSLELRDLRLEDSGRYRCEVIDGLEDESGLVELELRGVVFPYQSREGRYQLNFHEAQQACQEQGAMVATFEQLFRAWEEGLDWCNAGWLQDASVQYPIVLPRQPCGGLGLAPGVRSYGQRHHRLHRYDVFCFAAALKGRVYYLENPKKLTLLEAREACQEDGAQISTVGQLFAAWKFRGLDRCDAGWLADGSARYPIVHPRLNCGPPEPGVRTFGFPDPHTRYGVYCYVQH

SEQ ID NO: 280 - protein, 359 aa, Rattus norvegicus
  Rat HAPLN3 NP_001008559
MGLLFLVLLSPLSCVLGLPFYNGFYYSNGLHGRTLGNGYGEGLFNGVKLVVETTEESLFSHQGASVTLPCHYHYEPALASPRHVRIKWWKLSENGTPEQDVLVAIGQRHRSFGDYQGRVQLRQDKEQEVSLELRDLRLEDSGRYRCEVIDGLEDESGLVELELRGVVFPYQPREGRYQLNFHEAQQVCQEQDAVVATFEQLFRAWEEGLDWCNAGWLQDASVQYPIVLPRQPCGGLGLAPGVRSYGQRHHRLHRYDVFCFAAALKGRVYYLENPEKLTLLEAREACQEDGAQISTVGQLFAAWKFRGLDRCDAGWLADGSARYPIIHPRPNCGPPEPGVRTFGFPDPNTRYGVYCYHQH

SEQ ID NO: 281 - protein, 360 aa, Bos taurus
  Cow HAPLN3 NP_001092451.1
MGLRLPILLLLLCCVSGLPFYNGFYYSNRPNGRNLGNSYSEGIFNGVKLVVETPEETLFSHRGANVTLPCRYHYEPALASPRPVRIKWWKLSENGVPEQDVLVAIGLRQRTFGDYRGRVRLRQDRAREVSLEIRDLRLEDYGRYRCEVIDGLEDESGLVELELRGVVFPYQHPQGRYKFNFHEAQQACEEQDAVVASFEQLFRAWEEGLDWCNAGWLQDASVQYPVTQARRPCGGLGLAPGVRSYGPRHRRLHRYDVFCFAVALRGQVYYLEHPEKLTLAEAREACQEDGAQIAKVGQLFAAWKFRGLDRCDAGWLADGSARYPVAHPRSNCGALEPGVRSFGFPDPHSRQYGVYCYRPR

SEQ ID NO: 282 - protein, 402 aa, Mus musculus; identical to SEQ ID NO: 232
  Mouse HAPLN4 Q80WM4

SEQ ID NO: 283 - protein, 421 aa, Bos taurus
  Cow HAPLN4 KIAA1926 DAA28318
MRERSPSAWGPLGEGRTGRMVCARAALGPGALWAAAWGVLLLTAAAEAQRGRKKVVHVLEGESGSVVVQTAPGQVVSHRGGTIVLPCRYHYEAATHGHDGVRLKWTKVVDPLAFADVFVALGPQHRAFGSYRGRAELQGDGPGDASLVLRNVTLQDYGRYECEVTNELEDDTGMVKLDLEGVVFPYHPRGGRYKLTFAEAQRACAEQDGILASAEQLHAAWRDGLDWCNAGWLRDGSVQYPVSQPREPCGGLGGAGSAGAGGGASGGVRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDASRRLFGVYCYRAPGAPDPAPGGWGWGWAGGGGWAGGSRDPAAWTPLRV

SEQ ID NO: 284 - protein, 400 aa, Rattus norvegicus
  Rat HAPLN4 NP_001101868
MACAPGALGHRALWAVAWGLLLLVPVLAGAQRGRKKVVHVLEGESGSVVVQTAPGQVVSHRGGTIVLPCRYHYEAAAHGHDGVRLKWTKVVDPLAFADVFVALGPQHRAFGPYRGRAELQNDGPGDASLVLRNVTLQDYGRYECEVTNELEDDAGMVKLDLEGVVFPYHPRGGRYKMTFAEAQRACAEQDGILASAEQLHTAWRDGLDWCNAGWLRDGSVQYPVSQAREACGGSGSPGAGGGTNGGVRNYGYRHNAEERYDAFCFTSNLPGRVFFLKPLRPVALAGAVRACAARGATVAKVGQLFAAWKLQLLDRCTAGWLADGSARYPIVNPRTRCGGPRPGVRSLGFPDASRRLFGVYCYRAPGAPDPAPGGWGWGWAGGGGWAGGSRDPAAWTPLRV

SEQ ID NO: 285 - protein, 537 aa, Sus scrofa
  Pig Aggrecan Q29011
  VARIANT 45, 49, 146: Xaa = any amino acid
AISVEVSEPDNSLSVSIPQPSPLRVLLGGSLTIPCYFIDPMHPVXTAPXTAPLAPRIKWSRVSKEKEVVLLVATEGQVRVNSAYQDRVTLPNYPAIPSDATLEIQNLRSNDSGIYRCEVMHGIEDSEATLEVVVKGIVFHYRAISXRYTLDFDRAQRACLQNSAIIATPEQLQAAYEDGFHQCDAGWLADQTVRYPIHTPREGCYGDKDEFPGVITYGIRDTNETYDVYCFAEEMEGEVFYATSPEKFTFQEAANECRRLGARLATTGQLYLAWRGGMDMCSAGWLADRSVRYPISKARPNCGGNLLGVRTVYLHANQTGYPDPSSRYDAICYTGEDFVDIPENFFGVGGEEDITIQTVTWPDVELPLPRNITEGEARGTVILTVKPVFEFSPTAPEPEEPFTFAPGTGATAFPEAENRTGEATRPWAFPEESTPGLGAPTAFTSEDLVVQVTSAATEEGTEGPSATEAPSTSEEPFPSEKPFPSEEPFPSEEPFPSEKPSASEEPFPSEQPSTLSAPVPSRTELPGSGEVSGAPEV

SEQ ID NO: 286 - protein, 2109 aa, Gallus gallus
  CHICKEN AGGRECAN P07898
MTTLLLVFVCLQAITTAASAELSDSSDGLEVKIPEQSPLRVVLGSSLNIPCYFNIPEEEDTNALLTPRIKWSKLSNGTEIVLLVATGGKIRLNAEYREVISLPNYPAIPTDATLEIKALRSNHTGIYRCEVMYGIEDRQDTIEVLVKGVVFHYRAISTRYTLNFERAKQACIQNSAVIATPEQLQAAYEDGYEQCDAGWLADQTVRYPIHLPRERCYGDKDEFPGVRTYGVRETDETYDVYCYAEQMQGKVFYATSPEKFTFQEAFDKCHSLGARLATTGELYLAWKDGMDMCSAGWLADRSVRYPISRARPNCGGNLVGVRTVYLNPANQTGYPHPSSRYDAICYSGDDFEALVPGLFTDEVGTELGSAFTIQTVTQTEVELPLPRNVTEEEARGSIATLEPMEITATATELYEAFTVLPDLFATSVTVETASPREENVTREEITGIWAVPEEVTTSVSGTAFTTGMAEVSSVEEAIAVTATPGLESASPFTIEDHLVQVTAAPDVALLPRQPISPTGVVFHYRAATSRYAFSFIQAQQACLENNAVIATPEQLQAAYEAGFDQCDAGWLRDQTVRYPIVNPRSNCVGDKESSPGVRSYGMRPASETYDVYCYIDRLKGEVFFATQPEQFTFQEAQLYCESQNATLASAGQLHAAWKQGLDRCYPGWLADGSLRYPIVSPRPACGGDAPGVRTIYQHHNQTGFPDPLSRHHAFCFRALPSVVEEGVTSLFEEEVMVTQLIPGVEGIPSGEETTVETELSSEPENQTAQGTEVFPTDVSLLSARPSAFPPATVIPEETSTNASIPEVSGEFPESGEHPTSGEPSASGAPDTSGEPTSVGFELSGEQSGIGESGLPSVDLQSSGFVPGESGLPSGDVSGLPSGIVDISGLPSAEEEVTVSVSRIPEVSGMPSGAESSGLHSGFSGEISGTELISGLPSGEESGLASGFPTISLVDSTLVEVVTAAPGRQEEGKGSIGVSGEEELSGFPSAEWDSSGARGLPSGAETSGEQSGVPELSGEHSGVPGLSGEAFEVPELSGEHSGVTELSGEHSGLPELSGEPFGVPELSGFPSGLDISGEPSGAPEVSGPVDVSGLTSGVDGSGEVSGVTFISTSLQEVTTPSVAEAEAKEILEISGLPSGETSGMVSGSLDVSGQPSGHIGFGGSASGVLEMSGFPGGAVESSGEASGVEVTSGLASGEESGLTSGFPTVSLVDTTLVEVVTQTSVAQEVGEGPSGMIEISGFLSGDRGVSGEGSGAVQSSGLPSGTGDFSGEPSGIPYFSGDISGATDLSGQPSAVTDISGEDSGLPEVTLVTSDLVEVVTRPTVSQELGGETAVTFPYVFGPSGEGSASGDLSGGASAEGGIETSTAYEISGESSAFPETSIETSTDQEISGEASAYPEISVETSTHLETSGETSAYPEISTETSTIQEVSGETSAFPEISTETSTIQEISGETSAFPEIRIETSTFQEISGETSAFPEIRIETSTSQEARGETSAFPEITIEASTVHETSGETSAFPEISIETSTVHETSGETSAFPEISIETSTVHEISGESSAFPEIRIETSTSQEARGETSAFPEITIEASTIQEISGETSAFPEISIETSTVREISGETSAFPEIRIETSTSQEARGETSALPEITIETSTVHETSGEASAFPEISIETSTRQEARSEASAYPEVSIEASTTQEVSGESSAFPEISVETSTSQEARGETSAFPEIGIETSTAHEGSGETPGLPAVSTDTAATSLASGEPSGAPEKETPDTTSHLITGVSGETSVPDAVISTSAPDVELAQEPRNTEETQLEIEPSTPAASGQETETAAVLDNPHLPATATAALHPASQEAVDALGPTTEDTDECHSSPCLNGATCVDGIDSFKCLCLPSYGGDLCEIDLANCEEGWIKFQGHCYRHFEERETWMDAESRCREHQAHLSSIITPEEQEFVNSHAQDYQWIGLSDRAVENDFRWSDGHSLQFENWRPNQPDNFFFAGEDCVVMIWHEQGEWNDVPCNYHLPFTCKKGTVACGDPPVVENARTFGRKKDRYEINSLVRYQCDHGYIQRHVPTIRCQPNGHWEEPRISCTNPSSYQRRLYKRSPRSRLRPGVVHRPTH

SEQ ID NO: 287 - protein, 2132 aa, Mus musculus
  MOUSE AGGRECAN Q61282
MTTLLLVFVTLRVIAAVISEEVPDHDNSLSVSIPQPSPLKVLLGSSLTIPCYFIDPMHPVTTAPSTAPLTPRIKWSRVSKEKEVVLLVATEGQVRVNSIYQDKVSLPNYPAIPSDATLEIQNLRSNDSGIYRCEVMHGIEDSEATLEVIVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQGGMDMCSAGWLADRSVRYPISKARPNCGGNLLGVRTVYLHANQTGYPDPSSRYDAICYTGEDFVDIPENFFGVGGEDDITIQTVTWPDLELPLPRNVTEGEALGSVILTAKPIFDLSPTISEPGEALTLAPEVGSTAFPEAEERTGEATRPWGFPAEVTRGPDSATAFASEDLVVRVTISPGAAEVPGQPRLPGGVVFHYRPGSTRYSLTFEEAQQACMHTGAVIASPEQLQAAYEAGYEQCDAGWLQDQTVRYPIVSPRTPCVGDKDSSPGVRTYGVRPSSETYDVYCYVDKLEGEVFFATRLEQFTFQEARAFCAAQNATLASTGQLYAAWSQGLDKCYAGWLADGTLRYPIITPRPACGGDKPGVRTVYLYPNQTGLPDPLSKHHAFCFRGVSVAPSPGEEGGSTPTSPSDIEDWIVTQVGPGVDAVPLEPKTTEVPYFTTEPRKQTEWEPAYTPVGTSPQPGIPPTWLPTLPAAEEHTESPSASEEPSASAVPSTSEEPYTSSFAVPSMTELPGSGEASGAPDLSGDFTGSGDASGRLDSSGQPSGGIESGLPSGDLDSSGLSPTVSSGLPVESGSASGDGEVPWSHTPTVGRLPSGGESPEGSASASGTGDLSGLPSGGEITETSTSGAEETSGLPSGGDGLETSTSGVDDVSGIPTGREGLETSASGVEDLSGLPSGEEGSETSTSGIEDISVLPTGGESLETSASGVGDLSGLPSGGESLETSASGAEDVTQLPTERGGLETSASGVEDITVLPTGRESLETSASGVEDVSGLPSGREGLETSASGIEDISVFPTEAEGLDTSASGGYVSGIPSGGDGTETSASGVEDVSGLPSGGEGLETSASGVEDLGPSTRDSLETSASGVDVTGFPSGRGDPETSVSGVGDDFSGLPSGKEGLETSASGAEDLSGLPSGKEDLVGSASGALDFGKLPPGTLGSGQTPEVNGFPSGFSGEYSGADIGSGPSSGLPDFSGLPSGFPTVSLVDSTLVEVITATTSSELEGRGTIGISGSGEVSGLPLGELDSSADISGLPSGTELSGQASGSPDSSGETSGFFDVSGQPFGSSGVSEETSGIPEISGQPSGTPDTTATSGVTELNELSSGQPDVSGDGSGILFGSGQSSGITSVSGETSGISDLSGQPSGFPVFSGTATRTPDLASGTISGSGESSGITFVDTSFVEVTPTTFREEEGLGSVELSGFPSGETELSGTSGTVDVSEQSSGAIDSSGLTSPTPEFSGLPSGVAEVSGEFSGVETGSSLPSGAFDGSGLVSGFPTVSLVDRTLVESITQAPTAQEAGEGPSGILEFSGAHSGTPDISGELSGSLDLSTLQSGQMETSTETPSSPYFSGDFSSTTDVSGESIAATTGSGESSGLPEVTLNTSELVEGVTEPTVSQELGHGPSMTYTPRLFEASGDASASGDLGGAVTNFPGSGIEASVPEASSDLSAYPEAGVGVSAAPEASSKLSEFPDLHGITSAFHETDLEMTTPSTEVNSNPWTFQEGTREGSAAPEVSGESSTTSDIDTGTSGVPSATPMASGDRTEISGEWSDHTSEVNVAISSTITESEWAQPTRYPTETLQEIESPNPSYSGEETQTAETTMSLTDAPTLSSSEGSGETESTVADQEQCEEGWTKFQGHCYRHFHDRETWVDAERRCREQQSHLSSIVTPEEQEFVNKNAQDYQWIGLNDRTIEGDFRWSDGHSLQFEKWRPNQPDNFFATGEDCVVMIWHERGEWNDVPCNYQLPFTCKKGTVACGDPPVVEHARTLGQKKDRYEISSLVRYQCTEGFVQRHVPTIRCQPSGHWEEPRITCTDPNTYKHRLQKRSMRPTRRSRPSMAH

SEQ ID NO: 288 - protein, 2364 aa, Bos taurus
  COW AGGRECAN P13608
MTTLLLVFVTLRVITAAISVEVSEPDNSLSVSIPEPSPLRVLLGSSLTIPCYFIDPMHPVTTAPSTAPLAPRIKWSRISKEKEVVLLVATEGRVRVNSAYQDKVTLPNYPAIPSDATLEIQNMRSNDSGILRCEVMHGIEDSQATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQGGMDMCSAGWLADRSVRYPISKARPNCGGNLLGVRTVYLHANQTGYPDPSSRYDAICYTGEDFVDIPESFFGVGGEEDITIQTVTWPDVELPLPRNITEGEARGSVILTAKPDFEVSPTAPEPEEPFTFVPEVRATAFPEVENRTEEATRPWAFPRESTPGLGAPTAFTSEDLVVQVTLAPGAAEVPGQPRLPGGVVFHYRPGSSRYSLTFEEAKQACLRTGAIIASPEQLQAAYEAGYEQCDAGWLQDQTVRYPIVSPRTPCVGDKDSSPGVRTYGVRPPSETYDVYCYVDRLEGEVFFATRLEQFTFWEAQEFCESQNATLATTGQLYAAWSRGLDKCYAGWLADGSLRYPIVTPRPACGGDKPGVRTVYLYPNQTGLLDPLSRHHAFCFRGVSAAPSPEEEEGSAPTAGPDVEEWMVTQVGPGVAAVPIGEETTAIPGFTVEPENKTEWELAYTPAGTLPLPGIPPTWPPTGEATEEHTEGPSATEVPSASEKPFPSEEPFPPEEPFPSEKPFPPEELFPSEKPFPSEKPFPSEEPFPSEKPFPPEELFPSEKPIPSEEPFPSEEPFPSEKPFPPEEPFPSEKPIPSEEPFPSEKPFPSEEPFPSEEPSTLSAPVPSRTELPSSGEVSGVPEISGDFTGSGEISGHLDFSGQPSGESASGLPSEDLDSSGLTSTVGSGLPVESGLPSGEEERITWTSAPKVDRLPSGGEGPEVSGVEDISGLPSGGEVHLEISASGVEDISGLPSGGEVHLEISASGVEDLSRIPSGEGPEISASGVEDISGLPSGEEGHLEISASGVEDLSGIPSGEGPEVSASGVEDLIGLPSGEGPEVSASGVEDLSRLPSGEGPEVSASGVEDLSGLPSGEGPEVSVSGVEDLSRLPSGEGPEVSASGVEDLSRLPSGEGPEISVSGVEDISILPSGEGPEVSASGVEDLSVLPSGEGHLEISTSGVEDLSVLPSGEGHLETSSGVEDISRLPSGEGPEVSASGVEDLSVLPSGEDHLEISASGVEDLGVLPSGEDHLEISASGVEDISRLPSGEGPEVSASGVEDLSVLPSGEGHLEISASGVEDLSRLPSGGEDHLETSASGVGDLSGLPSGREGLEISASGAGDLSGLTSGKEDLTGSASGALDLGRIPSVTLGSGQAPEASGLPSGFSGEYSGVDLESGPSSGLPDFSGLPSGFPTVSLVDTTLVEVVTATTAGELEGRGTIDISGAGETSGLPFSELDISGGASGLSSGAELSGQASGSPDISGETSGLFGVSGQPSGFPDISGETSGLLEVSGQPSGFYGEISGVTELSGLASGQPEISGEASGILSGLGPPFGITDLSGEAPGIPDLSGQPSGLPEFSGTASGIPDLVSSAVSGSGESSGITFVDTSLVEVTPTTFKEEEGLGSVELSGLPSGELGVSGTSGLADVSGLSSGAIDSSGFTSQPPEFSGLPSGVTEVSGEASGAESGSSLPSGAYDSSGLPSGFPTVSFVDRTLVESVTQAPTAQEAGEGPSGILELSGAPSGAPDMSGDHLGSLDQSGLQSGLVEPSGEPASTPYFSGDFSGTTDVSGESSAATSTSGEASGLPEVTLITSELVEGVTEPTVSQELGQRPPVTYTPQLFESSGEASASGDVPRFPGSGVEVSSVPESSGETSAYPEAEVGASAAPEASGGASGSPNLSETTSTFHEADLEGTSGLGVSGSPSAFPEGPTEGLATPEVSGESTTAFDVSVEASGSPSATPLASGDRTDTSGDLSGHTSGLDIVISTTIPESEWTQQTQRPAEARLEIESSSPVHSGEESQTADTATSPTDASIPASAGGTDDSEATTTDIDECLSSPCLNGATCVDAIDSFTCLCLPSYQGDVCEIQKLCEEGWTKFQGHCYRHFPDRATWVDAESQCRKQQSHLSSIVTPEEQEFVNNNAQDYQWIGLNDKTIEGDFRWSDGHSLQFENWRPNQPDNFFATGEDCVVMIWHEKGEWNDVPCNYQLPFTCKKGTVACGEPPVVEHARIFGQKKDRYEINALVRYQCTEGFIQGHVPTIRCQPSGHWEEPRITCTDPATYKRRLQKRSSRPLRRSHPSTAH

SEQ ID NO: 289 - protein, 2333 aa, Canis familiaris
  DOG AGGRECAN Q28343
MTTLLWVFVTLRVITAASSEETSDHDNSLSVSIPEPSPMRVLLGSSLTIPCYFIDPMHPVTTAPSTAPLAPRIKWSRITKEKEVVLLVATEGQVRINSAYQDKVSLPNYPAIPSDATLEIQNLRSNDSGIYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVLYATSPEKFTFQEAANECRRLGARLATTGQLYLAWQGGMDMCSAGWLADRSVRYPISKARPNCGGNLLGVRTVYLHANQTGYPDPSSRYDAICYTGEDFVDIPENFFGVGGEEDITIQTVTWPDVELPLPRNITEGEARGNVILTVKPIFDLSPTAPEPEEPFTFVPEPEKPFTFATDVGVTAFPEAENRTGEATRPWGVPEESTPGPAFTAFTSEDHVVQVTAVPGAAEVPGQPRLPGGVVFHYRPGSARYSLTFEEAQQACLRTGAVIASPEQLQAAYEAGYEQCDAGWLQDQTVRYPIVSPRTPCVGDKDSSPGVRTYGVRPPSETYDVYCYVDKLEGEVFFITRLEQFTFQEALAFCESHNATLASTGQLYAAWRQGLDKCYAGWLSDGSLRYPIVTPRPSCGGDKPGVRTVYLYPNQTGLPDPLSRHHVFCFRGVSGVPSPGEEEGGTPTPSVVEDWIPTQVGPVVPSVPMGEETTAILDFTIEPENQTEWEPAYSPAGTSPLPGIPPTWPPTSTATEESTEGPSGTEVPSVSEEPSPSEEPFPWEELSTLSPPGPSGTELPGSGEASGVPEVSGDFTGSGEVSGHPDSSGQLSGESASGLPSEDLDSSGLTSAVGSGLASGDEDRITLSSIPKVEGEGLETSASGVEDLSGLPSGREGLETSTSGVGDLSGLPSGEGLEVSASGVEDLSGLPSGEGPETSTSGVGDLSRLPSGEGPEVSASGVGDLSGLPSGREGLETSTSGVEDLSGLPSGEGPEASTSGVGDLSRLPSGEGPEVSASGVEDLSGLPSGEGLEASASGVGDLSGLPSGEGPEASASGVGDLSRLPSGEGPEVSASGVEDLSGLSSGESPEASASGVGDLSGLPSGREGLETSASGVGDLSGLPSGEGQEASASGVEDLSRLPSGEGPEASASGVGELSGLPSGREGLETSASGVGDLSGLPSGEGPEAFASGVEDLSILPSGEGPEASASGVGDLSGLPSGREGLETSTSGVGDLSGLPSGREGLETSTSGVGDLSGLPSGEGPEASASGIGDISGLPSGREGLETSSSGVEDHPETSASGVEDLSGLPSGVEGHPETSASGVEDLSDLSSGGEGLETSASGAEDLSGFPSGKEDLIGSASGALDFGRIPSGTLGSGQAPEASSLPSGFSGEYSGVDFGSGPISGLPDFSGLPSGFPTISLVDTTLVEVITTTSASELEGRGTIGISGAGETSGLPVSELDISGAVSGLPSGAELSGQASGSPDMSGETSGFFGVSGQPSGFPDISGGTSGLFEVSGQPSGFSGETSGVTELSGLYSGQPDVSGEASGVPSGSGQPFGMTDLSGETSGVPDISGQPSGLPEFSGTTSGIPDLVSSTMSGSGESSGITFVDTSLVEVTPTTFKEKKRLGSVELSGLPSGEVDLSGASGTMDISGQSSGATDSSGLTSHLPKFSGLPSGAAEVSGESSGAEVGSSLPSGTYEGSGNFHPAFPTVFLVDRTLVESVTQAPTAQEAGEGPSGILELSGAHSGAPDVSGDHSGSLDLSGMQSGLVEPSGEPSSTPYFSGDFSGTMDVTGEPSTAMSASGEASGLLEVTLITSEFVEGVTEPTVSQELAQRPPVTHTPQLFESSGEASASGEISGATPAFPGSGLEASSVPESSSETSDFPERAVGVSAAPEASGGASGAPDVSEATSTFPEADVEGASGLGVSGGTSAFPEAPREGSATPEVQEEPTTSYDVGREALGWPSATPTASGDRIEVSGDLSGHTSGLDVVISTSVPESEWIQQTQRPAEAHLEIEASSPLHSGEETQTAETATSPTDDASIPTSPSGTDESAPAIPDIDECLSSPCLNGATCVDAIDSFTCLCLPSYRGDLCEIDQELCEEGWTKFQGHCYRYFPDRESWVDAESRCRAQQSHLSSIVTPEEQEFVNNNAQDYQWIGLNDRTIEGDFRWSDGHSLQFENWRPNQPDNFFVSGEDCVVMIWHEKGEWNDVPCNYYLPFTCKKGTVACGDPPVVEHARTFGQKKDRYEINSLVRYQCTEGFVQRHVPTIRCQPSGHWEKPRITCTDPSTYKRRLQKRSSRAPRRSRPSTAH

SEQ ID NO: 290 - protein, 2124 aa, Rattus norvegicus
  RAT AGGRECAN P07897
MTTLLLVFVTLRVIAAVISEEVPDHDNSLSVSIPQPSPLKALLGTSLTIPCYFIDPMHPVTTAPSTAPLTPRIKWSRVSKEKEVVLLVATEGQVRVNSIYQDKVSLPNYPAIPSDATLEIQNLRSNDSGIYRCEVMHGIEDSEATLEVIVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRTVGARLATTGQLYLAWQGGMDMCSAGWLADRSVRYPISKARPNCGGNLLGVRTVYLHANQTGYPDPSSRYDAICYTGEDFVDIPENFFGVGGEEDITIQTVTWPDLELPLPRNITEGEARGNVILTAKPIFDMSPTVSEPGEALTLAPEVGTTVFPEAGERTEKTTRPWGFPEEATRGPDSATAFASEDLVVRVTISPGAVEVPGQPRLPGGVVFHYRPGSTRYSLTFEEAQQACIRTGAAIASPEQLQAAYEAGYEQCDAGWLQDQTVRYPIVSPRTPCVGDKDSSPGVRTYGVRPSSETYDVYCYVDKLEGEVFFATQMEQFTFQEAQAFCAAQNATLASTGQLYAAWSQGLDKCYAGWLADGTLRYPIVNPRPACGGDKPGVRTVYLYPNQTGLPDPLSKHHAFCFRGVSVVPSPGGTPTSPSDIEDWIVTRVEPGVDAVPLEPETTEVPYFTTEPEKQTEWEPAYTPVGTSPLPGIPPTWLPTVPAAEEHTESPSASQEPSASQVPSTSEEPYTPSLAVPSGTELPSSGDTSGAPDLSGDFTGSTDTSGRLDSSGEPSGGSESGLPSGDLDSSGLGPTVSSGLPVESGSASGDGEIPWSSTPTVDRLPSGGESLEGSASASGTGDLSGLPSGGEITETSASGTEEISGLPSGGDDLETSTSGIDGASVLPTGRGGLETSASGVEDLSGLPSGEEGSETSTSGIEDISVLPTGESPETSASGVGDLSGLPSGGESLETSASGVEDVTQLPTERGGLETSASGIEDITVLPTGRENLETSASGVEDVSGLPSGKEGLETSASGIEDISVFPTEAEGLETSASGGYVSGIPSGEDGTETSTSGVEGVSGLPSGGEGLETSASGVEDLGLPTRDSLETSASGVDVTGYPSGREDTETSVPGVGDDLSGLPSGQEGLETSASGAEDLGGLPSGKEDLVGSASGALDFGKLPSGTLGSGQTPEASGLPSGFSGEYSGVDIGSGPSSGLPDFSGLPSGFPTVSLVDSTLVEVITATTASELEGRGTISVSGSGEESGPPLSELDSSADISGLPSGTELSGQTSGSLDVSGETSGFFDVSGQPFGSSGTGEGTSGIPEVSGQAVRSPDTTEISELSGLSSGQPDVSGEGSGILFGSGQSSGITSVSGETSGISDLSGQPSGFPVLSGTTPGTPDLASGAMSGSGDSSGITFVDTSLIEVTPTTFREEEGLGSVELSGLPSGETDLSGTSGMVDVSGQSSGAIDSSGLISPTPEFSGLPSGVAEVSGEVSGVETGSSLSSGAFDGSGLVSGFPTVSLVDRTLVESITLAPTAQEAGEGPSSILEFSGAHSGTPDISGDLSGSLDQSTWQPGWTEASTEPPSSPYFSGDFSSTTDASGESITAPTGSGETSGLPEVTLITSELVEGVTEPTVSQELGHGPSMTYTPRLFEASGEASASGDLGGPVTIFPGSGVEASVPEGSSDPSAYPEAGVGVSAAPEASSQLSEFPDLHGITSASRETDLEMTTPGTEVSSNPWTFQEGTREGSAAPEVSGESSTTSDIDAGTSGVPFATPMTSGDRTEISGEWSDHTSEVNVTVSTTVPESRWAQSTQHPTETLQEIGSPNPSYSGEETQTAETAKSLTDTPTLASPEGSGETESTAADQEQCEEGWTKFQGHCYRHFPDRETWVDAERRCREQQSHLSSIVTPEEQEFVNKNAQDYQWIGLNDRTIEGDFRWSDGHSLQFEKWRPNQPDNFFATGEDCVVMIWHERGEWNDVPCNYQLPFTCKKGTVACGEPPAVEHARTLGQKKDRYEISSLVRYQCTEGFVQRHVPTIRCQPSADWEEPRITCTDPNTYKHRLQKRTMRPTRRSRPSMAH

SEQ ID NO: 291 - protein, 394 aa, Oryctolagus cuniculus
  RABBIT AGGRECAN Q28670
  VARIANT 289: Xaa = any amino acid
STAPLTPRIKWSRISKDKEVVLLVANEGRVRINSAYQDKVSLPNYPAIPSDATLEIQSLRSNDSGIYRCEVMHGLEDSEATLEVVVKGVVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAASECRRLGARLATTGQLYLAWQAGMDMCSAGWLADRSVRYPISKARPNCGGNLLGVRTVYVHANQTGYPDPSSRYDAICYTGEXFMDIPENFFGVGGEEDITVQTVTWPDVELPVPRNITEGEARGSVVLTAKPVLDVSPTAPQPEETFAPGLGATAFPGVENGTEEATRPRGFADEAALGPSSATAFT

SEQ ID NO: 292 - protein, 883 aa, Rattus norvegicus
  RAT BREVICAN P55068
MIPLLLSLLAALVLTQAPAALADDLKEDSSEDRAFRVRIGAAQLRGVLGGALAIPCHVHHLRPPPSRRAAPGFPRVKWTFLSGDREVEVLVARGLRVKVNEAYRFRVALPAYPASLTDVSLVLSELRPNDSGVYRCEVQHGIDDSSDAVEVKVKGVVFLYREGSARYAFSFAGAQEACARIGARIATPEQLYAAYLGGYEQCDAGWLSDQTVRYPIQNPREACYGDMDGYPGVRNYGVVGPDDLYDVYCYAEDLNGELFLGAPPGKLTWEEARDYCLERGAQIASTGQLYAAWNGGLDRCSPGWLADGSVRYPIITPSQRCGGGLPGVKTLFLFPNQTGFPSKQNRFNVYCFRDSAHPSAFSEASSPASDGLEAIVTVTEKLEELQLPQEAVESESRGAIYSIPITEDGGGGSSTPEDPAEAPRTPLESETQSVAPPTGSSEEEGEALEEEERFKDTETPKEEKEQENLWVWPTELSSPLPTGLETEHSLSQVSPPAQAVLQVGASPSPRPPRVHGPTVETLQPPGEGSLTSTPDGAREVGGETGSPELSGVPREREEAGSSSLEDGPSLLPETWAPVGTREVETPSEEKSGRTVLTGTSVQAQPVLPTDSASRGGVAVAPSSGDCIPSPCHNGGTCLEEKEGFRCLCVPGYGGDLCDVGLHFCSPGWEPFQGACYKHFSTRRSWEEAESQCRALGAHLTSICTPEEQDFVNDRYREYQWIGLNDRTIEGDFLWSDGPPLLYENWNPGQPDSYFLSGENCVVMVWHDQGQWSDVPCNYHLSYTCKMGLVSCGPPPQLPLAQIFGRPRLRYAVDTVLRYRCRDGLAQRNLPLIRCQENGLWEAPQISCVPRRPARALRSMTAPEGPRGQLPRQRKALLTPPSSL

SEQ ID NO: 293 - protein, 883 aa, Mus musculus
  MOUSE BREVICAN Q61361
MIPLLLSLLAALVLTQAPAALADDLKEDSSEDRAFRVRIGATQLRGVLGGALAIPCHVHHLRPPHSRRAAPGFPRVKWTFLSGDREVEVLVARGLRVKVNEAYRFRVALPAYPASLTDVSLVLSELRPNDSGVYRCEVQHGIDDSSDAVEVKVKGVVFLYREGSARYAFSFAGAQEACARIGARIATPEQLYAAYLGGYEQCDAGWLSDQTVRYPIQNPREACSGDMDGYPGVRNYGVVGPDDLYDVYCYAEDLNGELFLGAPPSKLTWEEARDYCLERGAQIASTGQLYAAWNGGLDRCSPGWLADGSVRYPIITPSQRCGGGLPGVKTLFLFPNQTGFPSKQNRFNVYCFRDSAHPSASSEASSPASDGLEAIVTVTEKLEELQLPQEAMESESRGAIYSIPISEDGGGGSSTPEDPAEAPRTPLESETQSIAPPTESSEEEGVALEEEERFKDLEALEEEKEQEDLWVWPRELSSPLPTGSETEHSLSQVSPPAQAVLQLGASPSPGPPRVRGPPAETLLPPREGSPTSTPGGAREVGGETGSPELSGVPRESEEAGSSSLEDGPSLLPATWAPVGPRELETPSEEKSGRTVLAGTSVQAQPVLPTDSASHGGVAVAPSSGDCIPSPCHNGGTCLEEKEGFRCLCLPGYGGDLCDVGLHFCSPGWEAFQGACYKHFSTRRSWEEAESQCRALGAHLTSICTPEEQDFVNDRYREYQWIGLNDRTIEGDFLWSDGAPLLYENWNPGQPDSYFLSGENCVVMVWHDQGQWSDVPCNYHLSYTCKMGLVSCGPPPQLPLAQIFGRPRLRYAVDTVLRYRCRDGLAQRNLPLIRCQENGLWEAPQISCVPRRPGRALRSMDAPEGPRGQLSRHRKAPLTPPSSL

SEQ ID NO: 294 - protein, 912 aa, Bos taurus
  COW BREVICAN Q28062
MAPLFLPLLATLVLAWIPVALADALEGDSSEDRAFRVRIAGDAPLQGVLGGALTIPCHVHYLRPSPSRRAAQGSPRVKWTFLSGGREAEVLVARGLRVKVSEAYRFRVALPAYPASLTDVSLVLSELRPNDSGIYRCEVQHGIDDSSDAVEVKVKGVVFLYREGSARYAFSFAGAQEACARIGARIATPEQLYAAYLGGYEQCDAGWLSDQTVRYPIQTPREACYGDMDGFPGVRNYGVVDPDDLYDVYCYAEELNGELFLGAPPDKLTLEEARTYCQERGAKIATTGQLYAAWDGGLDRCSSGWLSDGSVRYPIVTPSQRCGGGLPGVKTLFLFPNQTGFPNKHSRFNVYCFRDSAQPSAIPEAANPASHLASDALEAIVTVTETLEELKLPQEAVESESRGAIYSIPIIEDGGGGSSTPEDPAEAPRTLLEFETQSIVPPLGSSEEEGKVLEQEEKYRGEEEKEEEEEEEEVEDEALWAWPSELSSLDPEAPLPTEPVPEESLTQASPPVRAALQPGVSPPPYDEPEAPRPPRVLGPPTKTLPTPREGNLASPPPSTLVGAREIEEETGGPELSGAPRGESEETGSSEDAPSLLPATRAPGDTRDLETPSEENSRRTVPAGTSVRAQPVLPTDSASRGGVAVAPSSGDCVPSPCHNGGTCLEEEEGVRCLCLPGYGGDLCDVGLHFCSPGWDAFQGACYKHFSARRSWEEAENKCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAEVFGRPRLRYEVDTVLRYRCREGLTQRNLPLIRCQENGRWGLPQISCVPRRPARALRPVEAQEGRPWRLVGHWKARLNPSPNPAPGP

SEQ ID NO: 295 - protein, 417 aa, Felis catus
  CAT BREVICAN P41725
  VARIANT 367: Xaa = any amino acid
MAPLFLPLLIALALAPGPTASADVLEGDSSEDRAFRVRISGNAPLQGVLGGALTISCHVHYLRPPPGRRAVLGSPRVKWTFLSGGREAEVLVARGLRVKVSEAYRFRVALPAYPASLTDVSLALSELRPNDSGIYRCEVQHGIDDSSDAVEVKVKGVVFLYREGSARYAFSFARAQEACARIGARIATPEQLYAAYLGGYEQCDAGWLSDQTVRYPIQTPREACYGDMDGFPGVRNYGLVDPDDLYDIYCYAEDLNGELFLGAPPDNVTLEEATAYCRERGAEIATTGQLYAAWDGGLDRCSPGWLADGSVRYPIVTPSQRCGGGLPGVKTLFLFPNQTGFPNKYSRFNVYCFRDSGQPSTTPEASXPASDGLEAIVTVTETLEELHVPREAVESESRGAIYSVPIVEDGGGARSPP

SEQ ID NO: 296 - protein, 3357 aa, Mus musculus
  MOUSE VERSICAN Q62059
MLINMKGILWMCSTLLLTHALHQAKMETSPPVKGSLSGKVVLPCHFSTLPTLPPNYNTSEFLRIKWSKMEVDKNGKDIKETTVLVAQNGNIKIGQDYKGRVSVPTHPDDVGDASLTMVKLRASDAAVYRCDVMYGIEDTQDTMSLAVDGVVFHYRAATSRYTLNFAAAQQACLDIGAVIASPEQLFAAYEDGFEQCDAGWLSDQTVRYPIRAPREGCYGDMMGKEGVRTYGFRSPQETYDVYCYVDHLDGDVFHITAPSKFTFEEAEAECTSRDARLATVGELQAAWRNGFDQCDYGWLSDASVRHPVTVARAQCGGGLLGVRTLYRFENQTCFPLPDSRFDAYCFKPKQNISEATTIEMNILAETSSPSLSKEPHMVPDRATPVIPLATELPIFTTHFPPAGNIVNSEQKSVVYSQAITGRLATESPTTTRNTINSWDLNDSLASGSGPLGMPDISEIKEEELRSTTVISQHATGSQAVITEDTQTHESVSQIEQIEVGPLVTSMEITNHISLKELPEKNKTPYESTEVTLEHTTEMPTVSASPELATTSHYGFTLREDDREDRTLTVRSDQSTRVFSQIPEVITVSKTSEDTTYSQLGDLESISTSTITMLGTDRSLIDKEKEPKTNGKVTEDEFGQSQPTTTFPSQHLTEVELLPYSGDTTSVEGISTVIYPSLQTDVTQGRERTETPRPELKKDPYTVDEIPEKVTKDPFIGKTEEVFSGMPLSTSSSESSVERTESVSPALTIEKLTGKPTEARDVEEMTTLTRLETDVTKSDKDVTRVHLTHSTLNVEVVTVSKWPGDEDNSTSKPLPSTEHAGFTKLPPVPLSTIGINGKDKEIPSFTDGGGEYTLFPDGTPKPLEKVSEEDLASGELTVTFHTSTSIGSAEKSASGEPTTGDRFLPTTSTEDQVINATAEGSALGEDTEASKPLFTGPPFVHTSDVEELAFVNYSSTQEPTTYVDISHTSPLSIIPKTEWSVLETSVPLEDEILGKSDQDILEQTHLEATMSPGALRTTGVSQGETQEEPQTPGSPFPTFSSTAVMAKETTAFEEGEGSTYTPSEGRLMTGSERVPGLETTPVGTSYPPGAITDQEVEMDTMVTLMSTIRPTVVSSTESEVIYEAEGSSPTEFASTLRPFQTHVTQLMEETTEEGKKASLDYTDLGSGLFEPRATELPKFPSTPSDISVFTAIDSLHRTPPLSPSSSFTEEQRVFEEESSEKTTGDILPGESVTQHPVTTLIDIVAMKTESDIDHMTSKPPVTQPTRPSVVERKTTSKTQELSTSTPAAGTKFHPDINVYIIEVRENKTGRLSDMIVSGHPIDSESKEEEPCSEETDPLHDLFAEILPELPDSFEIDIYHSEEDEDGEEDCVNATDVTTTPSVQYINGKQLVTTVPKDPEAAEARRGQYESVAPSQNFPDSSATDTHQFILAETESSTTMQFKKSKEGTELLEITWKPETYPETPDHVSSGEPDVFPTLSSHDGKTTRWSESITESSPNLENPVHKQPKPVPLFPEESSGEGAIEQASQETILSRATEVALGKETDQSPTLSTSSILSSSVSVNVLEEEPLTLTGISQTDESMSTIESWVEITPSQTVKFSESSSAPIIEGSGEVEENKNKIFNMVTDLPQRDPTDTLSPLDMSKIMITNHHIYIPATIAPLDSKLPSPDARPTTVWNSNSTSEWVSDKSFEGRKKKENEDEEGAVNAAHQGEVRAATERSDHLLLTPELESSNVDASSDLATWEGFILETTPTESEKEMANSTPVFRETIGVANVEAQPFEHSSSSHPRVQEELTTLSGNPPSLFTDLGSGDASTGMELITASLFTLDLESETKVKKELPSTPSPSVEISSSFEPTGLTPSTVLDIEIAGVMSQTSQKTLISEISGKPTSQSGVRDLYTGFPMGEDFSGDFSEYPTVSYPTMKEETVGMGGSDDERVRDTQTSSSIPTTSDNIYPVPDSKGPDSTVASTTAFPWEEVMSSAEGSGEQLASVRSSVGPVLPLAVDIFSGTESPYFDEEFEEVAAVTEANERPTVLPTAASGNTVDLTENGYIEVNSTMSLDFPQTMEPSKLWSKPEVNLDKQEIGRETVTKEKAQGQKTFESLHSSFAPEQTILETQSLIETEFQTSDYSMLTTLKTYITNKEVEEEGMSIAHMSTPGPGIKDLESYTTHPEAPGKSHSFSATALVTESGAARSVLMDSSTQEEESIKLFQKGVKLTNKESNADLSFSGLGSGGALPPLPTTSVNLTDMKQIISTLYAETSHMESLGTSILGDKMEDHERMEDVSSNEVRMLISKIGSISQDSTEALDTTLSHTGTEEPTTSTLPFVKLMDLERSPKQDPSGGKRKPKTHRPQTMSGLISNENSSASEAEEGATSPTAFLPQTYSVEMTKHFAPSESQPSDLFNVNSGEGSGEVDTLDLVYTSGTTQASSQGDSMLASHGFLEKHPEVSKTEAGATDVSPTASAMFLHHSEYKSSLYPTSTLPSTEPYKSPSEGIEDGLQDNIQFEGSTLKPSRRKTTESIIIDLDKEDSKDLGLTITESAIVKSLPELTSDKNIIIDIDHTKPVYEYIPGIQTDLDPEIKLESHGSSEESLQVQEKYEGAVTLSPTEESFEGSGDALLAGYTQAIYNESVTPNDGKQAEDISFSFATGIPVSSTETELHTFFPTASTLHIPSKLTTASPEIDKPNIEAISLDDIFESSTLSDGQAIADQSEVISTLGHLEKTQEEYEEKKYGGPSFQPEFFSGVGEVLTDPPAYVSIGSTYLIAQTLTELPNVVRPSDSTHYTEATPEVSSLAELSPQIPSSPFPVYVDNGVSKFPEVPHTSAQPVSTVTSSQKSIESPFKEVHANIEETIKPLGGNVHRTEPPSMSRDPALDVSEDESKHKLLEELETSPTKPETSQDFPNKAKDHIPGETVGMLAGIRTTESEPVITADDMELGGATQQPHSASAAFRVETGMVPQPIQQEPERPTFPSLEINHETHTSLFGESILATSEKQVSQKILDNSNQATVSSTLDLHTAHALSPFSILDNSNETAFLIGISEESVEGTAVYLPGPDLCKTNPCLNGGTCYPTETSYVCTCAPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSALQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAMPKITCMNPSAYQRTYSKKYLKNSSSAKDNSINTSKHEHRWSRRQETRR

SEQ ID NO: 297 - protein, 2738 aa, Rattus norvegicus
  RAT VERSICAN Q9ERB4
MLINMNGILWMCSTLLLTHALHKAKMEENPPVKGSLSGKVILPCHFSTLPTLPPDYNTSEFLRIKWSKIEVDKNGKDIKETTVLVAQDGNIKIGQDYKGRVSVPTHPDDVGDASLTMVKLRASDAGVYRCDVMYGIEDTQNTMSLAVDGVVFHYRAATSRYTLNFESAQQACLDIGAVIATPEQLFAAYEDGFEQCDAGWLSDQTVRYPIRAPREGCYGDMMGKEGVRTYGFRSPQETYDVYCYVDHLDGDVFHITAPSKFTFEEAEAECANRDARLATVGELHAAWRNGFDQCDYGWLSDASVRHPVTVARAQCGGGLLGVRTLYRFENQTCFPLPDSRFDAYCFKRSPLSIIPKTEWSVSETSVPLEDEVLGKSDQDTLEQTHLEATMSPEALSTIEVTQGETQEEPQTPGIPFPALSSTAVMTKETTAFEEEGEGSTYTLSEDRLMTDSEIVPSLETTPVGTSYPGGAMTQQEVEMDTMVTQMSSIRPTVVLSTEPEVSYEAEGSSPMEFASTLKPFGTQVTQLVEETTEEGKKTPLDYTDLGSGLFEQPRVTELPDFSMTPSDISVFTAIDSLHRTTPLRPPSPFTEEPHIFEKEPSEKTTGDIILPRESVTQHPLTTLMDIIAKKTESDIDHEYHMTSKPPVMQPTRPSVVERKTTSKPQELSTSPPPAGTKFHPDINVYIIEVRENKTGRMSDMVVNGHPIDSESKEEEPCSEETDPLHDLFAEILPELPDSFEIDIYHSEEDEDGEEDCVNATDVTTTPSVQYITGKPHVTTVPKNPEAAEARRGLYESVAPSQNFSNTSATDTHQFIPAETELSTTMQFTKSKEATELLEITWKPETYPETPEHFSSGEPDVFPTLPSHDGKTTKWSEFITESNPNTENPEHKQPKPIPLFPEEFSGEGAIDQASQQTIFSRATEVALGKETDQSPTISTSSIRSGSVSVHALEEDPIALTGISQTDESMSTVESWVEMTPSQTVEFSGSSSAPTIEGSGEVEEYTNKIFNTVTDLPQREPTDTLIPLDMSNIMITDHHIYTPATTAPLDSQLPSTDARPTQFGIQTTTSEWVSSTSFEGRKTEEDKERDTNAAHTGEVQPATERSDRLLLTSELESSNVAASSPLDTWEGFVPETTSTVSEKEMANTTPVFTETSDVANLETQSFEHSSSSQPRVQEELTTLSGKPPLIFMDLGSGDASTDMEFITASSFTLDLESDTKVKKELPSTLSPSVETSSSSEPIGLAPSTVLDIEIVEVMNQTSKKTLISELSGKPTSQAEVRDLYPGLGEDFSGDSSEYPTVSSTTMKEETVGMGGSENERVKDTQTLSSIPPTSDNINPVPDSKGFGSTVASTTAFPWEEFMTSAEGSGEELSSVRSSVSLVLPLGVDILPTTESPYFDQEFEEAAAVTEAGKQSALPIAVSGNTVDLTENRDIEVNSTMSVDLPQTMEPAKLWSKPEVNPEKQEIGSETVTQDKAQGQKSFESLHSSLAPEQTTLESQSLIETEVQTSYYSMLTTMKTYNTNEEVEEEGTSIAHMSTPGPGIKGLESYPTHPEATGKSYSFSASALVTESGPARSVVMDSSTQEEESIKLFQKDMILTHKESNSDLSFSGLGSGEALPPLPTTSVSLTDMGKINSTLYPETSHMESLGTSILGDNHERMKNVSNEVRTLISETGSISQDSTEAPNTTLSDTRTEESTTSPLPFMKLMDTEHSPKQTLRWEEEIQTHRPQTMTGQMTNDNSSVSEAEAAATSAPAFLPETYSVEMTKAFATSPSQTSDLFDANSGEGSGEVDGLDLVYTSRTTQASSQGDSMFASHGFIEKHPEVSRTETGATDGSPTASAMFLHQSEYNESSLYPTSTLPSTVTYESPSEGIADGLQDHIRFEVSTLKPSRRKATESVIIDLDKEDSKDLGLAITESAIVEILPELTSDRNIIIDIDHTKPVYEYIPGIQTDLDSDIPLGSHGSSEESLEVQEKYEATINLSPTEEAFDGSGDALPAGHTQAIYNESVTPSDGKQPEDISFSFATGIPVSSTETELNTFFPTVSTLHIPSKLTTASPEIDKPNIEAISLDDIFESSTLSDGQAIADQSEVISTLGHLEKTQEEYEEKKYGGPSFQPEFFSGVGEVFTDAPAYVSIGRTYSVAQPLTEFPNVVGQSDSTHYTEATSAVSSVTELSPQTPSSPSPVYIDSGVSEFTEVPHKSAQPAPTAASSQKLIEGSFKKVRANIEATIKSLGENDHGTESPSMSPSPALDISEDDSKPKLLEDLETSPTKTETSQDSPNKANDQIPGKTAGILAGIKTTESGPVVTAADDMELGDATQRPHSASAPAAFRVETSMVPQPIPQEPERPTFPSLEINHETHTSLFEESILATSEKQVSQRILDYSNQATVSTLDLNTEHSIPPFSILDNSNETAFLIGISEETVEGTAVYLPGPDLCKTNPCLNGGTCYPTETSYVCTCAPGYSGDQCELDFDECHSNPCRNGATCVDGLNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSALQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAMPKITCMNPSAYQRTYSKKYLKNSSSVKDNSINTSKHEHRWSRRWQETRR

SEQ ID NO: 298 - protein, 862 aa, Macaca nemestrina
  PIG-TAILED MACAQUE VERSICAN Q28858
YPIRAPRVGCYGDMMGKAGVRTYGFRSPQETYDVYCYVDHLDGDVFHLTAPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAASGTISTNFPQTMEPAKLWSRQEVNPERQEIESETTSEEQIQEEKSFESPQNSPATEQTIFDSQTFTETELKTTGYSVLTTKKTYSDDKEMEEEGTSLANMSTPVPDANGVESFTTLPEATEKSHFFLATALVTESIPAEHVVTDSPIKEEESTKHFPKGMRPTIQELDTELLFSGLGSGEEVLPTLPTKSVNFTEVEQIRNTFYPHTSQVESTSSDKLEDFNRMENVAKEVGPLGSQTDIFEGNESVTSTTLIEILSDPGAEGPTVAPLPFFANIGHPQNQTLRWAEEIQTSKLEPSEEDGKPELLEETEASPTEFIAVEGTEILQDFQNKTDGQVSGEAIKMFPTIKTPEAGTVITTANEIKLEGATQWPHSTSASATYGIEAGVMPWLSPQTSERPTLSSSPEINPETQAALIRGQDSTVAASEQQVTARILDTNDQATVSPVEFNTEVATPPFSLLETSNETDFLIGINEESVEGTAIYLPGPDRCKMNPCLNGGTCYPTETSYVCTCVPGYSGDQCELDFDECHSNPCRNGATCADGFNTFRCLCLPSYVGALCEQDIETCDYGWHKFQGQCYKYFAHRRTWDAAERECRLQGAHLTSILSHEEQMFVNRVGHDYQWIGLNDKMF

SEQ ID NO: 299 - protein, 3381 aa, Bos taurus
  COW VERSICAN P81282
MLINIKSILWMCSTLIAAHALQKVNMEKSPPVKGSLSGKVNLPCHFSTMPTLPPSYNTTSEFLRIKWSKIELDKTGKDLKETTVLVAQNGNIKIGQDYKGRVSVPTHPEDVGDASLTMVKLLASDAGRYRCDVMYGIEDTQDTVSLTVEGVVFHYRAATSRYTLNFEMAQKACVDIGAVIATPEQLHAAYEDGFEQCDAGWLSDQTVRYPIRVPREGCYGDMMGKEGVRTYGFRAPHETYDVYCYVDHLDGDVFHITAPNKFTFEEAGEECKTQDARLATVGELQAAWRNGFDRCDYGWLLDASVRHPVTVARAQCGGGLLGVRTLYRFENQTGFPTPDSRFDAYCFKPKQNISEATTIELNMLAETVSPTLLEELQVGLDRMTPIVPLITELPVITTKVPPIGNIVNFEQKSTVQPLTSTHRSATESLPPDGSMKKPWDMDYYSPSASGPLGEPDVSEIKEEVPQSTTVVSHHAPDSWDGVKEDLQIKDSVTQIEQIEVGPLVTSMEISKHIPSKEFTVTVTPFVSTTMTLESKTEKKAISTVSESVTTSHYGFTLREGDGEDRISTVRSGQSTSIFSQIPEVITVSKTSEDTTRGQLEDVESVSASTIVSPDSDGSPMDHRQEKQTHGRITEGFLGQYVSTTPFPSQHHTEVELFPYSGDKRLVEGTSTVISPTPRTGRERTETLRPAMRTVTYTNDEIQEKITKDSSIEKIEEEGFSGMKFPTASPEQIHHTKYSVGMTKSFESPALMTTTKPGVTPTEATDVEEDFTTPSGLETDGYQDTTEYEEGITTVHLIQSTLNVEVVTVSKWSLDEDNTTSKPLGSTEHVGSPKLPPALITTTGVSGKDKEMPSLTEDGRDEFTRIPGSTQRPLEEFTEEDTTDHEKFTVRFQPTTSIATTEKSTLRDSITEERVPPFTSTEVRVTHATIEGSALDEGEDVDVSKPLSTVPQFAHPSDVEGSTFVNYSSTQEPTTYVDTSHTIPLPVIPKTEWGVLVPSIPSEGEVLGEPSQDIRVINQTHFEASMYPETVRTTTEITQEATREDFLWKEQTPEKPVSPPSSTTDTAKETTPPLDEQESDGSAYTVFEDRSVMGSDRVSVLVTTPIGKFEQHTSFPPGAVTKAKTDEVVTLTPTTGSKVTFSPWPKQKYETEGTSPRGFVSPFSIGVTQLIEETTTEKREKTSLDYIDLGSGLFEKPKATELPEFSTVKATVPSDTAAFSSADRLHTPSASTEKPPLIDREPDEETTSDMVIIGESTSRVPPTTLEDIVAKKTETDIDREYFTTSSTSTTQPTRPPTVEGKEAFGPQAFSTPEPPAGTKFHPDINVYIIEVRENKTGRMSDFSVSGHPIDSESKEDEPCSEETDPEHDLIAEILPELLGMLHSEEDEEDEECANATDVTTTPSVQYINGKHVVTTVPKDPEAAEARRGQFESVAPSQNFSDSSESDSHQFIITHAGLPTAMQPNESKETTESLEITWRPEIYPETAEPFSSGEPDIFPTASIHEGEATEGPDSITEKNPELDHLVHEHAESVPLFPEESSGDAAIDQESQKIIFSGATEGTFGEEAEKSSTTHTPSMVASSVSAPVSEDASFILTGTPQSDEPLSTVESWVEITPRHTVEFSGSPSIPIPEGSGEAEEDKDKIFAMITDLSQRNTTDPRVTSDTSKIMITESLVDVPTTTIYSISEQVSAVVPTKFVRETDTYEWVFSPPLEETTRKEEEKGTTGTASTVEVHSPTQRLDQFVSPSELESSSETPPDDSAAATRKSFTSQMTPTQSERETTSSTVVFKETEVLDNLAAQTTDPSLSSQPGVLEVSPTVPGSPVSLFMEQGSGEAAVDPETTTVSSLSLNIEPEILAKEEAAGAWSPNVETVFPFEPTEQVLSTAVDREVAETISQTSKENLVSEISGEPTHRAEIKGFSTDFPLEEDFSGDFREYSTVSYPITKEEIVMMEGSGDAAFKDTQMLPSVTPTSDLSNHTADSEEPGSTLVSTSAFPWEEFTASAEGSGEPLLSVSSSVDQVFPSAAGKASGTDSPFIDQRLGEEGAINETDQRSTILPTAEAESTKASTEEGEVKENHTVSMDFPPTVEPDELWPRQEVNPVRQGNGSEIVSEEKTQEQESFEPLQSSVAPEQTTFDSQTFPEPGLQTTGYFTLTTKKTYSTDERMEEEVISLADVSTPTLDSKGLVLYTTLPEVTEKSHFFLATASVTESVPAESVIAGSTIKEEESIKPFPKVTSPIIKESDTDLIFSGLGSGEEVLPTLGSVNFTEIEQVLSTLYPLTSQVQSLEASILNDTSGDYEGMENVANEMRPLISKTDSIFEDGETASSTTLPEILSDARTEGPFTAPLTFSTGPGQPQNQTHRRAEEIQTSRPQPLTDQVSSENSVTAETKETATPATDFLARTYDLEMAKGFVTPTPKPSDLFYEHSGEGSGELDAVGAEVHASGMTQATRQGSTTFVSDRSLEKHPKVPSVEAVTVNGFPTVSMVLPLHPEQREGSPEATGTPASTASYEKATEGAADSFQDHFWGFKDSTLKPDKRKATESIIIDLDKEDKDLILTMTESTILEIIPELTSDKNTVIDIDHTKPIYEDILGMQTDLDPEVPSGPPDSSEESTQVQEKYEAAVNLSSTEENFEASGDILLANYTQATPESKAPEDRNPLDHTDFIFTTGIPILSSETELDVLLPTATSLPIPSKSATVNPESKTEAKTLEDIFESSTLSDGQAIADQSEVISTLGYLERTQNEDEAKKYVSPSFQPEFSSGAEEALTDPTPYVSIGTTYLTAQSLTEAPDVMEGARLPDSIDTSTVSAFSELLSQTPSFPPLSIHLGSGDSEHSEDLQPSALPSTDASTPPVSSGELANIEATFKPSSEEDFYITEPPSLPPDTEPSEDESKPKLLEPTEASATELIAQEEIEIFQNSDNTTSVQVSGEAVKVFPSIETPEAEAIVTAASETKLEGATLRPHSTSASVIHGVEAGVVPQPSPQTSERPTILSPLEISPETQAALIRGEDSTVAAPKQQVPTRMLDSNKQATLSTTELNTELATPSFPLLETSNETSFLIGINEESVEGTAVYLPGPDRCKMNPCLNGGTCYPTETSYVCTCVPGYSGDRCELDFDECHSNPCRNGATCIDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSTGEDCVVIIWHENGQWNDVPCNYHLTYTCKKGTVACGQPPVVENAKTFGKMKPRYEINSLIRYHCKDGFIQRHLPTIRCLGNGRWAMPKITCLNPSAYQRTYSKKYFKNSSSAKDNSINTSKHDHRWSRRWQESRR

SEQ ID NO: 300 - protein, 3562 aa, Gallus gallus
  CHICKEN VERSICAN Q90953
MLLNIKSIIWMCSTLAITYMLPKVKAEKKTLVKGSLSGTSVLPCFFSTTPTIASSYAAEYLRIKWSKVELDKSGKDAKETTVLVAQNGNIKIGQNYKDRVSVPTHSEETGDASLTFSRLRASDAGVYRCDVMYGVEDTQGIVSLAVDGVVFHYRAATSRYTLNFTQAQQTCLDNGAVIASPEQLKAAYEDGFEQCDAGWLSDQTVRYPIRHPRIGCFGDKMGKKGVRTYGRRFPNETYDVYCYVEHMQDEVVHVSVPEKLTFEEAKELCRKRDGVLASVGNMYVAWRNGFDQCDYGWLADGSVRYPASVARPQCGGGLLGVRTLYRYENQTGFPYPDSKFDAYCYERKKIVSEPTTVKLVTTLKTDSVELSSAKVTLKPSVFESSVTEVAVTKTKVPAWEEATLETEDTKMTTEVAEEKREMEVLMENIKLTTLLPQTVTDGEISPYDTLGRTEYDVSPRLTESTSAALEVEHTYSEAELSEEQGRSESTEDAFLTSVVFQDSTAVAKSSTGSWEDIETGDTQKHDGDNQTEQIEVGPVMTATDSLVPASQRELPRTGSSVSLTKENLYLGSHSTKEPTKKSMEAKSDKKLTTVVIPKALFTDQYDLTTGGEGRESMYTVMPDRVSGVALVSIPESDVPAVSETLMDELAVTTGQSSTADESTPFIKFSSSATELDNEASAEGSREDLKDVHLTTSSGIPVSFTLFTANETGSEVTALSESTSAPQKFEEGITSVLHSSQQTEGSAILEKQEKTKEPEMSTIDAKVLYITTVVPASVTAGSEGRFGSEKFTHTPPVSGMWLQTDKDQVYMTEETSHTKRIELDTEDDISGMEPTSSPGQIIEYTKHLGAPVSAVTDETKTSMETAETESDEEVVSADFDQTKGTTEVFHTSSSLDLEKFTLSKIPEDESSATVKSFSSSSGTVLPTAVATVLEVTDHEADETSGYVLNMTFSTPEGEQRKATEKSPATSAEDEVSTGTEISKYTMTEGGQISSVTSAEKESVAALQEREEQPSVGLPETKEPFKFTDVTEIETTVPQREGDTSLVPVTVGSEDIGEMQVTDHTSFDSIIHTEATVTSTKASEVFPKELSTKDQDRELGTAMGSTLPVTSVQMHEQKTTAGFESPQTTTQEKHDEMGSAYDEMYPATELSVPALMLTEYGQVSGPVETSTRSLHLTGTPKAETATDQEEKITEAVPVTFGTQAKVYESKGTTTREEDRDVGSWNSVLPPHTMLSSPSTAGSISLLTLGASPSQTPEGSGISEELEEVKTVPFSSRATDKTTVISDLTTSSISAVDKIQPTSASKPFVSSKSPRIIPEEDEEVTSSDIIVIDESISPSKASAEDDLTGKMVEPEIDKEYFTSSTATAVARPTAPPTVMEATEALQPQEVSPTSHPDSGTDIRLYVIQITGNDTDHPVNEFLDLFSRHILPHAVDETHTDAESAQTEPCTSDSVQDSSEYIILDPFFPNFMDFEEEEEDCENTTDVTTPPALQFINGKQQVTSAPKSTKAEEARSDQIESVAHSKNVTFSQINETNTFIISETEASGTMQPSKAGEVMGAFEVTQPTADVAMLEPVYSGESEVTTTDKYLEITSVYEQSPKKNKETVMWHGTEESSTKDTKNLLLITNESSGDGSTESDLSRSVFTEILTMSSHEDSEKISHTTSVPTILSVERSAVTAAPSADSDTATVGIDVKDLIPKGGTATPGNYYKSTIKLDAEFPFESNPEATSHTTKPDMTASSFIVLEGSGDVEENSTLASAMTTETAVAETLSVQDTSLGSGTVLPTEISVTISEITPALPGGTRILYSTFDQSSEATVSTNFVSELIMEQVVGSSVATEKKVEDEKEVQTTVYSSQEISTTDAKGKSELDEFGSTTNEVRTVSQEPTPLREIVPITGTMHSEIKKVTATPFLREKLFINEGSAEEPADLFAGSPTRKVVSTDSPFTDSGSGDIDVITESATLTSVPSRSVIETQTVKHEGNINVISVSLKNTTTEYEEHIGTGGPVTSVSSTGSDGLTEESEVAIEMSENVFSTENQGEPTQEAVPTYTAPSDIKSRLGSRREVTSHVTPVIRTKDLETAEVTSSPESVVNNSTLDTMVTHGTIRAVAESTESKKGKGSFSAVSLGKILMIEHGSGEELKVDSSTTKLMSNGPTEKLLGSHFSFFDQGSGEAETLTESFTKASVSPTGKPEPQEQYGRKTVSMPSAVVHAYTAEPNELVTSTEHDITSLQTVTDTEMEEKAANELTVTSFATNLPLSEDVHSWEDRPREILPKAIESSGEATEDPFFISTQANHEHVEFLSVPTIRPHSEENKVEAESDEKILLPFNNDRVTESAVIERKYLSSPFTDTEQEEELVQNIFPTEDIPRLFLTPKEEKPTNNELISDPLFSGQGSGDEFTVIPSVESLAVKETTNTLSPWPFHPASVGPKLSTDKTQVFESGSTDSNAEINEEITTTAAELTETAYSMATSSPALEEESSSHSNSKDKDITHYFLVIEDPYNKEMDHRRGENGTSRPLPTPGDVSLEESSHMLTTDDVTPVSVILSETPYLEMGKSLATSATKMPSRVLPESSGEGSGWDGVSDSFAPDTLTHSTAPSVMEVELTASSHIPGVYSEVMTTHVPGDGSQTVITGLASLFTEEKEIVANRTAADPKTGTSEELTSDTGMSLDIIPVVDDRRHVTLNVSVYGDITLIEERLQIPSEKTTIIDMDHSKSMPEDIISVQTMPNLVIRSTQVSDDNMKAEEDKYDSILNFSTVEENSFGSGDNLSLTTSIQPSSESVTAGHGPKLVDKDLGSGYAMQFATETLTTTVLNELGIFLPTVPSLVSPHMPHESKESEFEAKHIGRTSTTDDVYEPYTSANNQVITDQSKTMSISGFSGMGQEESGDKKPMIPSLTPDLTMETEKALTTDTFDVSMVTTQSMSQHATVSSSSSEEKHSTVYMQTKSASTEYEETDSVSLNSVSQNPKSSVTVWLVNGVSKYPEVIIPSTSSAKDSDQSDHSSDGTFKEVSSDMAATYKPPTTDLDTTVSSLLVFSPEPESESISTESTPHFNKFVTERSEETESSVNDLIIEENATVSGDSPSIHDYPTAFWNFGERTSTDVPKLSTIEVEFSSERVKNPSQESDRSTERERPRLSSAPVSDSPNSIEVGVFKPDQEAVTMLTSSLEPLDRSLETQSALLGPLLGQQEITTISSNIATNNTAPGNNPYSNEQSTISSELLNTIELVTSSFSLPEVTNGSDFLIGTSVGSVEGTAVQIPGQDPCKSNPCLNGGTCYPRGSFYICTCLPGFNGEQCELDIDECQSNPCRNGATCIDGLNTFTCLCLPSYIGALCEQDTETCDYGWHKFQGQCYKYFAHRRTWDTAERECRLQGAHLTSILSHEEQVFVNRIGHDYQWIGLNDKMFERDFRWTDGSPLQYENWRPNQPDSFFSAGEDCVVIIWHENGQWNDVPCNYHLTYTCKKGTVACGQPPVVENAKTFGKMKPRYEINSLIRYHCKDGFIQRHIPTIRCQGNGRWDMPKITCMNPSTYQRTYSKKYYYKHSSSGKGTSLNSSKHYHRWIRTWQDSRR

SEQ ID NO: 301 - protein, 1268 aa, Mus musculus
  Mouse Neurocan P55066
MGAGSVWASGLLLLWLLLLVAGDQDTQDTTATEKGLRMLKSGSGPVRAALAELVALPCFFTLQPRLSSLRDIPRIKWTKVQTASGQRQDLPILVAKDNVVRVAKGWQGRVSLPAYPRHRANATLLLGPLRASDSGLYRCQVVKGIEDEQDLVTLEVTGVVFHYRAARDRYALTFAEAQEACRLSSATIAAPRHLQAAFEDGFDNCDAGWLSDRTVRYPITQSRPGCYGDRSSLPGVRSYGRRDPQELYDVYCFARELGGEVFYVGPARRLTLAGARAQCQRQGAALASVGQLHLAWHEGLDQCDPGWLADGSVRYPIQTPRRRCGGPAPGVRTVYRFANRTGFPAPGARFDAYCFRAHHHTAQHGDSEIPSSGDEGEIVSAEGPPGRELKPSLGEQEVIAPDFQEPLMSSGEGEPPDLTWTQAPEETLGSTPGGPTLASWPSSEKWLFTGAPSSMGVSSPSDMGVDMEATTPLGTQVAPTPTMRRGRFKGLNGRHFQQQGPEDQLPEVAEPSAQPPTLGATANHMRPSAATEASESDQSHSPWAILTNEVDEPGAGSLGSRSLPESLMWSPSLISPSVPSTESTPSPKPGAAEAPSVKSAIPHLPRLPSEPPAPSPGPSEALSAVSLQASSADGSPDFPIVAMLRAPKLWLLPRSTLVPNMTPVPLSPASPLPSWVPEEQAVRPVSLGAEDLETPFQTTIAAPVEASHRSPDADSIEIEGTSSMRATKHPISGPWASLDSSNVTMNPVPSDAGILGTESGVLDLPGSPTSGGQATVEKVLATWLPLPGQGLDPGSQSTPMEAHGVAVSMEPTVALEGGATEGPMEATREVVPSTADATWESESRSAISSTHIAVTMARAQGMPTLTSTSSEGHPEPKGQMVAQESLEPLNTLPSHPWSSLVVPMDEVASVSSGEPTGLWDIPSTLIPVSLGLDESVLNVVAESPSVEGFWEEVASGQEDPTDPCENNPCLHGGTCHTNGTVYGCSCDQGYAGENCEIDIDDCLCSPCENGGTCIDEVNGFICLCLPSYGGSLCEKDTEGCDRGWHKFQGHCYRYFAHRRAWEDAERDCRRRAGHLTSVHSPEEHKFINSFGHENSWIGLNDRTVERDFQWTDNTGLQYENWREKQPDNFFAGGEDCVVMVAHESGRWNDVPCNYNLPYVCKKGTVLCGPPPAVENASLVGVRKIKYNVHATVRYQCDEGFSQHRVATIRCRNNGKWDRPQIMCIKPRRSHRMRRHHHHPHRHHKPRKEHRKHKRHPAEDWEKDEGDFC

SEQ ID NO: 302 - protein, 1257 aa, Rattus norvegicus
  Rat Neurocan P55067
MGAESVWASGLLVLWLLLLVSGDQDTQDTTTTEKGLHMLKSGSGPIQAALAELVALPCFFTLQPRQSPLGDIPRIKWTKVQTASGQRQDLPILVAKDNVVRVAKGWQGRVSLPAYPRHRANATLLLGPLRASDSGLYRCQVVKGIEDEQDLVTLEVTGVVFHYRAARDRYALTFAEAQEACHLSSATIAAPRHLQAAFEDGFDNCDAGWLSDRTVRYPITQSRPGCYGDRSSLPGVRSYGRRDPQELYDVYCFARELGGEVFYVGPARRLTLAGARALCQRQGAALASVGQLHLAWHEGLDQCDPGWLADGSVRYPIQTPRRRCGGSAPGVRTVYRFANRTGFPAPGARFDAYCFRAHHHTPQRGDSEIPSSGDEGEIVSAEGPPAPELKPRLGEQEVITPDFQEPLVSSGEDEPLDLTRTQASQETLASTPGGPTLASWLLTGVTSSTGVPSPSSLGVDMEETTPSGTQVAPTPTMRRGRFKGLNGRHFQQQGPEDQLLEAAEASAQPPTLEVTADHMGPSAATEALESDQSHSPWAILTNEVDVPGAGSLGSRSLPESRKWSPSLISPSTVPSTDSTPGLKPGADEAPGVKSAIHHPPWLPSEPAVPSSIPSEALSAVSLQASPGDGSPDFPIVAMLRAPKLWLLPHSTLVPNVSPIPLSPASPLPSSVPEEQAVRPVSFGAEDPETPFQTTMAAPGEASHGSPEADSIEIEGISSMQATKHPISGPWASLDSSNVTVNPVPSDAGILGTESGVLDLPGSPTSDGQATVDMVLATWLPLPGHGLDTGSQSTPMEAHGVTMSVEPTVALEGGATKDPMEATMDVVPSTVDATSGSEPKSSISSTHVVVTAAGDQGTPTLTPTSSEGQVVAQESLGTLTSLPSHPWSSLASSMDEVASVSSGEPTRLWDIPSTLIPVSLGLDESDLKVVAESPGLEGFWEEVASGQEDPTDPCENNPCLHGGTCRTNGTMYGCSCDQGYAGENCEIDIDDCLCSPCENGGTCIDEVNGFICLCLPSYGGNLCEKDTEGCDRGWHKFQGHCYRYFAHRRAWEDAERDCRRRAGHLTSVHSPEEHKFINSFGHENSWIGLNDRTVERDFQWTDNTGLQYENWREKQPDNFFAGGEDCVVMVAHENGRWNDVPCNYNLPYVCKKGTVLCGPPPAVENASLVGVRKVKYNVHATVRYQCDEGFSQHHVATIRCRSNGKWDRPQIVCTKPRRSHRMRRHHHHPHRHHKPRKEHRKHKRHPAEDWEKDEGDFC

SEQ ID NO: 303 - protein, 1321 aa, Pan troglodytes
  Chimpanzee Neurocan Q51S41
MGTPFVWALGLLMLQMLLFVAGEQGTQDIADASERGLHMQKLGSGSVQAALAELVALPCLFTLQPQPSAARDAPRIKWTKVRTASGQRQDLPILVAKDNVVKVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEEPLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAGNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATTTPPPSPAAETKVYSLPLSLTPTGQGGEAMPTTPESPGADFRETGETSPAQVNKAEHSSSSPWPSVNRNVAVGFVPTETATEPTGLRGISGSESGVLDTAESPTSGLQATVDEVQDPWPSVYSKGLGASSPSAPLGSPGVFLVPKVTPSLEPWVATDEGPTVNPMDSTVTLAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMKAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAERDCRRRSGHLTSVHSSEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 304 - protein, 381 aa, Mus musculus
  Mouse Layilin Q8C351
MQPGAALQAMLLAVLLAKPRDSKGRLLSASDLDPRGGQLVCRGGTRRPCYKVIYFHDAFQRLNFEEAKETCMEDGGQLVSIETEDEQRLIEKFIENLLASDGDFWIGLKRLEEKQSNNTACQDLYAWTDGSTSQFRNWYVDEPSCGSEVCVVMYHQPSAPPGIGGSYMFQWNDDRCNMKNNFICKYHDDKPSTTPSIWPGGEATEPATPLLPEETQKEDTKETFKERREAALNLAYILIPSIPLFLLLVVTSAVCWVWICRRKREQTDPSTKEQHTIWPTPRQENSPNLDVYNVIRKQSEADLAEPRPDLKNISFRVCSGEAMPDDMSCDYENIAVNPSESGFVTLASMESGFVTNDIYEFSPDRMGRSKESGWVENEIYY

SEQ ID NO: 305 - protein, 374 aa, Cricetulus griseus
  Chinese Hamster Layilin Q9Z209
MQPGPALQAVLLAVLLSEPRSSKGRLLSGQLVCRGGTRRPCYKVIYFHDAFQRLNFEEAKEACRRDGGQLVSIETEDEQRLIEKFIENLLASDGDFWIGLRRLEVKQVNNTACQDLYAWTDGSTSQFRNWYVDEPSCGSEVCVVMYHQPSAPPGIGGSYMFQWNDDRCNMKNNFICKYADEKPSTTPSIRPGGEATEPPTPVLPEETQKEDTKETFKESREAALNLAYILIPSIPLFLLLVVTSAACWVWICRRRKQEQPDPTTKEQHTIWPTPHQENSPNLDVYNVIRKQSEADLTEPRPDLKNISFRVCSSEAPPDDISCDYDNMAVNPSESGFVTLASMESGFVTNDIYEFSPDRMGRSKESGWVENEIYY

SEQ ID NO: 306 - protein, 376 aa, Rattus norvegicus
  Rat Layilin NP_001178926
MQPGAALQAMLLAVLLAKPRDSKGHLLSGDLDPRGGQRFCWEGTRRPCYRVIYFHDTSQRRNFEEAKEACMKDGGQLASIETADEQRLIENFIESLQASDGDFWIGLKRLEEKQHNSTACQDLYAWTDGSLSQFRNWYMDEPSCESEVCVVMYHQPSAPPGIGGPYMFQWNDDRCNTKKNFICKYSDDKPSTTPSLSPGGEATEPAAPILPEETLEIDTKERREAALNLAYILIPSIPLFLLLVVTSAVCWVWICRRKREQTDPPTKEQHTIWPTPHQENSPDLEVYNVIRKQSEADLAEPRPDLKNISFRVCSGEAMPDDTSCDYDNMVINPSESGLVTLASMEGRFVTNDIYEFSPDRMGRSKESGWVENEIYY

SEQ ID NO: 307 - protein, 794 aa, Mus musculus
  Mouse RHAMM Q00547
MSFPKAPLKRFNDPSGCAPSPGAYDVKTSEATKGPVSFQKSQRFKNQRESQQNLNIDKDTTLLASAKKAKKSVSKKDSQKNDKDVKRLEKEIRALLQERGTQDKRIQDMESELEKTEAKLNAAVREKTSLSASNASLEKRLTELTRANELLKAKFSEDGHQKNMRALSLELMKLRNKRETKMRSMMVKQEGMELKLQATQKDLTESKGKIVQLEGKLVSIEKEKIDEKCETEKLLEYIQEISCASDQVEKCKVDIAQLEEDLKEKDREILSLKQSLEENITFSKQIEDLTVKCQLLETERDNLVSKDRERAETLSAEMQILTERLALERQEYEKLQQKELQSQSLLQQEKELSARLQQQLCSFQEEMTSEKNVFKEELKLALAELDAVQQKEEQSERLVKQLEEETKSTAEQLTRLDNLLREKEVELEKHIAAHAQAILIAQEKYNDTAQSLRDVTAQLESVQEKYNDTAQSLRDVTAQLESEQEKYNDTAQSLRDVTAQLESEQEKYNDTAQSLRDVTAQLESVQEKYNDTAQSLRDVTAQLESYKSSTLKEIEDLKLENLTLQEKVAMAEKSVEDVQQQILTAESTNQEYARMVQDLQNRSTLKEEEIKEITSSFLEKITDLKNQLRQQDEDFRKQLEEKGKRTAEKENVMTELTMEINKWRLLYEELYEKTKPFQQQLDAFEAEKQALLNEHGATQEQLNKIRDSYAQLLGHQNLKQKIKHVVKLKDENSQLKSEVSKLRSQLVKRKQNELRLQGELDKALGIRHFDPSKAFCHASKENFTPLKEGNPNCC

SEQ ID NO: 308 - protein, 498 aa, Rattus norvegicus
  Rat RHAMM Q9WUF7
MGGGVSYVGWLEKSETEKLLEYIEEISCASDQVEKYKLDIAQLEEDLKEKDREILCLKQSLEEKVSFSKQIEDLTVKCQLLEAERDDLVSKDRERAESLSAEMQVLTEKLLLERQEYEKLQQNELQSQSLLQQEKELSAHLQQQLCSFQEEMTSERNVFKEQLKLALDELDAVQQKEEQSEKLVKQLEEETKSTAEQLRRLDDLLREKEIELEKRTAAHAQATVIAQEKYSDTAQTLRDVTAQLESYKSSTLKEIEDLKLENLTLQEKVAMAEKRVEDVQQQILTAESTNQEYAKVVQDLQNSSTLKEAEIKEITSSYLEKITDLQNQLRQQNEDFRKQLEEEGAKMTEKETAVTELTMEINKWRLLYEELYDKTKPFQQQLDAFEAEKQALLNEHGATQEQLSKIRDSYAQLLGHQNLKQKIKHVVKLKDENSQLKSEVSKLRSQLAKRKQNELRLQGELDKALGIRHFDPPKAFCHESKENVTLKTPLKEGNPNCC

SEQ ID NO: 309 - protein, 907 aa, Mus musculus
  Mouse Inter-alpha-trypsin inhibitor heavy chain H1 Q61702
MEGATGLRVLLCLLPLLTLQARPALGLATGRPRGSEKRHAVDTSVNGVSIKSLKVNCKVTSRFAHYVITSQVVNNADKAREVAFDVEIPKTAFISDFAITSDGKAFIGDIKDKVTAWKQYRKAAVLGESAGLVRASGRNMEQFTIHITVGAQSKATFRLTYEEVLKRRLMQYDITIKVRPKQLVQHFEIDVDIFEPQGISKLDAQASFLSEELAAQTIKKSFSGKKGHVLFRPTVSQQQSCPTCSTSLLNGEFKVTYDVNRDKLCDLLVANNYFTHFFAPKNLTNMSKNLVFVIDISGSMEGQKVRQTKEALLKILEDMRPVDNFDLVLFGSKVQSWKGSLVPASNANLQAAQDFVRRFSLAGATNLNGGLLRGIEILNKAQGSHPELSSPASILIMLTDGEPTEGETDRSQILKNVRNAIRGRFPLYNLGFGHDLDFSFLEVMSTENNGWAQRIYEDHDATQQLQGFYNQVANPLLTDVELQYPQDAVLALTQHRHKQYYDGSEIVVAGRIANHKLNTFKADVRARGEKQEFRATCLVDEEEMKKLLRERGHVLENHVERLWAYLTIQELLAKRMKTEGEERANLSSQVLKMSLDYHFVTPLTSLTIRGLTDEDGLEPTIDKPLEDSQPLEMVGPRRTFVLSAIQPSPTAHPIDSKLPLRVTGVDTDPHFIIYVPSKEDSLCFNINEEPGVILNLVQDPDTGFTVNGQLIGNKASSPGQHESTYFGRLGISSPTSDFQLEVTPQNITLNPSSSGSMFSWRDQAVLQKDGVVVTINKKRNLVVSVDDGATFEIVLHRTWKGSAVHQDFLGFYVLDSFRMSARTKGLLGQFFSPLDFEVFDLHPGSDPTKTDATMVVKNRQLTVTRGLQKDYSKDPRHGAEVPCWFVHDNGAGLIDGVHTDYVVSDIF

SEQ ID NO: 310 - protein, 946 aa, Mus musculus
  Mouse Inter-alpha-trypsin inhibitor heavy chain H2 Q61703
MQRPVCLLIWLFLLEAQAFEIPINGNSEFAEYSDLVELAPDKLPFVQENGRHQRSLPEESGEETDTVDPVTLYSYKVQSTITSRVATTTIQSKLVNNSPLPQSVVFDVQIPKGAFISNFTMTVNGMTFTSSIKEKTVGRALYSQARAKGKTAGWVRSRTLDMENFNTEVNIPPGAKVQFELHYQEVKWRKLGSYEHKIHLQPGKLAKHLEVNVWIIEPQGMRFLHVPDTFEGHFQGVPVISKGQQKAHVSFKPTVAQQRKCPNCTETAVNGELVVMYDVNREEKAGELEVFNGYFVHFFAPENLDPIPKNILFVIDVSGSMWGIKMKQTVEAMKTILDDLRTDDQFSVVDFNHNVRTWRNDLVSATKTQIADAKRYIEKIQPSGGTNINEALLRAIFILNEASNMGLLNPDSVSLIILVSDGDPTVGELKLSKIQKNVKQSIQDNISLFSLGIGFDVDYDFLKRLSNENRGIAQRIYGNQDTSSQLKKFYNQVSTPLLRNVQFNYPQASVTDVTQNNFHNYFGGSEIVVAGKFDPSKLTEVQSIITATSANTELVLETLSQMDDLEEFLSKDKHADPDFTKKLWAYLTINQLLAERSLAPTAAIKRKITKTILQMSLDHHIVTPLTAMVIENDAGDERMLADSPPQDHSCCSGALYYGTKVASGPIPSWANPSPTPMSAMLAVGAKPLESTPPTHLNQVENDPHFIIYLPKSKRNICFNIDSEPGKILSLVSDPESGIVVNGQLIGAKRAENGKLSTYFGKLGFYFQKEGMKIEISTETITLSSGSSTSRLSWSDTAHLGNSRVLISVKKEKSVTLTLNKELFFSVLLHRVWRKHPVNVDFLGIYAPPIDKFSPRVHGLLGQFMQEPAIHIFNERPGKEPGKPEASMEVKGHKLTVTRGLQKDYRTDIVFGTDVPCWFVHNSGKGFIDGHYKDYFVPQLYSFLKRP

SEQ ID NO: 311 - protein, 889 aa, Mus musculus
  Mouse Inter-alpha-trypsin inhibitor heavy chain H3 Q61704
MRTMWWPCLVLALLSGLETSGFPRSPLQLLGKRSLPEGVVDGIEVYSTKISCKVTSRFAHNVVTTRAVNRADTAKEVSFDVELPKTAFITNFTLTIDGVTYPGNVKEKEVAQKQYEKAVSQGKTAGLVKASGRKLEKFTVSVNVAAGSKVTFELTYEELLKRNKGKYEMYLKVQPKQLVRHFEIDAHIFEPQGISMLDAEASFITNDLLGSALTKSFSGKKGHVSFKPSLDQQRSCPTCTDSLLNGDFTIVYDVNRESPGNVQIVNGYFVHFFAPQGLPVVPKNIVFVIDVSGSMSGRKIQQTREALLKILDDVKEDDYLNFILFSTDVTTWKDHLVQATPANLKEAKTFVKNIHDQSMTNINDGLLKGIEMLNKAREDHTVPERSTSIIIMLTDGDANTGESRPEKIQENVRNAIGGKFPLYNLGFGNNLNYNFLETLALENHGLARRIYEDSDANLQLQGFYEEVANPLLTNVEVEYPENAILDLTRNSYPHFYDGSEIVVAGRLVDRNMDNFKADVKGHGALNDLTFTEEVDMEEMDAALKEQGYIFGDYIERLWAYLTIEQLLEKRKNAKGDEKENITAEALDLSLKYHFVTPLTSMVVTKPEDNEDQTSIADKPGEEAIAETTTMSFLTTQQSSQSPYYYVDGDPHFIIQIPGKNDSICFNIDEKPGTVLRLIQDPVTGITVTGQIIGDKRSNASSRTGKTYFGKLGITNAWMDFRVEVTTEKIILGTGAELSTFSWLDTITVTQTGLSVTINRKKNMVVSFGDGISFVIILHQVWKKHPVHQDFLGFYVVDSHRMSAQTHGLLGQFFQPFDFKVFGIRPGSDPTKPDATMVVKNHRLTVTRGSQKDYRKDASVGTKVICWFVHNNGEGLIDGVHTDYIVPSLF

SEQ ID NO: 312 - protein, 906 aa, Bos taurus
  Cow Inter-alpha-trypsin inhibitor heavy chain H1 Q0VCM5
MGLRGLLCVCLVSLLALQAVAAQGSPTRNPKGGKKRMAVDAAVDGVVIRSLKVNCKVTSRFAHYIITSQVVNSADTAKEVSFNVEIPKTAFISDFAITADENAFTGDIKDKVTAWKQYRKAAISGENAGLVRASGRTMEQFSIHIIVGPRSKATFRLTYEEVLRRKLMQYDIVIKVKPQQLVQHFEIDVDIFEPQGIRKLDVEASFLPKELAAQLIKKSFSGKKGHVLFRPTVSQQQTCPTCSTTLLNGDFKVTYDVNRDDACDLLVANNYFAHFFAPQNLKKLNKNVVFVIDISSSMEGQKLKQTKEALHKILGDMRPGDYFDLVLFGSAVQSWKGSLVQASPANLEAARNFVQQFSLAGATNLNGGLLRGIEILNKAQQSLPELSNHASILIMLTDGEPTEGVMDRTQILKNVRDGIKGRFPLYNLGFGHDVDLNFLEVMSLENNGRVQRIYEDHDATQQLQGFYEQVANPLLRDVELLYPREAVSDLTQHRHKQYYEGSEIMVAGRIADHKLSSFKADVRAHGEGQEFMTTCLVDKEEMKKLLRERGHMLENHVERLWAYLTIQELLAKRMKLEGQEKANVSAKALQMSLAYQFVTPLTSMTVRGMTDQDGLEPIIDKPLDDYLPLEMVGPRKTFMLQASQPAPTHSSLDIKKLPDQVTGVDTDPHFLIHVPQKEDTLCFNINEEPGVVLSLVQDPDTGFSVNGQLIGNEAGSPGKHEGTYFGRLGIANPATDFQLEVTPQNITLNPGSGGPVFSWRDQAFLRQNEVLVTINRKRNLVVSVEDGGTFEVVLHRVWRGSAVRQDFLGFYVLDSHRMSARTHGLLGQFFHPFDYKVSNLHPGSDPTKTDATMVVKNRRLTVTRGLQKDYRKDPRHGAEVTCWFIHNNGDGLIDGIHTDYIVPDIF

SEQ ID NO: 313 - protein, 946 aa, Bos taurus
  Cow Inter-alpha-trypsin inhibitor heavy chain H2 NP_001091485
MKGLTCFFLCFFLSESRGFEIPTNGLSEFADYGDHVELAPGKFQFVPENRRYQRSISGESGERTEDVDQVTVYSYKVQSTITSRVANTVIQTKVVNHSPQPQNVVFDVQIPKGAFISNFSMTVDGTTFTSSIKEKTVGRALYAQARAKGKTAGLVRSRALDMEDFKTEVSIAPGAKVQFELHYQEVKWRKLGSYEHRLHLKPGRLAKHLEVDVRIIEPQGLRSLHVLDTFDGHFDGVPVVSKGPQKAHIAFKPTVAQQRKCLNCSETMVDGELVVMYDVNREEKVGELEVFNGYFVHFFAPENMDPIPKNILFVIDVSGSMWGIKMKQTVEAMKTILDDLRTEDHFSVVDFNHNVRTWRNDLVSATKTQVADAKNYIEKIQPSGGTNINEALLRAIFILNEANNLGMLDPNSVSLIILVSDGDPTVGELKLSKIQKNVKQNIRDNISLFSLGIGFDVDYDFLKRLSNDNRGIAQRIYGNQDTSVQLKKFYNQVSTPLLRNVQFNYPQPSVTDVTQNSFHNYFGGSEIVVAGKVDPEKLGQLQSIITATSANAELVLETLAEMDGLEDFLSKDKHADPDFTKKLWAYLTINQLLAERSLAPTAAMKRKITKTILQMSLDHHIVTPLTAMVIENEAGDERMLADSPPQDHSCCSGALYHGSKVSPNSVPSWVNPSPAPVLPMPAVGAQVLESTPPPHVMRVENDPHFIIYLPKSQKNICFNIDSEPGKILNLVSDPELGILVNGQLVGAKKPKNKKLSTYFGKLGFYFQREDVKVEISTETISLSRGSRTSVLSWSDTAHVLNQRVLVSVKKEKTVTVTLDKEMFFSVLLHRVWKKHPINVDFLGIYIPPTNKFSPNVHGLIGQFMNEPKIHVFNERPGKDPEKPEASMEVKGQKLVVTRGLQKDYRTDRVFGTDVPCWFVHNSGKGFIDGHYKDYFVPQLYSFLRRP

SEQ ID NO: 314 - protein, 891 aa, Bos taurus
  Cow Inter-alpha-trypsin inhibitor heavy chain H3 P56652
MALAQWPYLILALLSGLAVSGFPRNPSLLLGKRSLPGRAVDGIEVYSTKVNCKVTSRFAHNVVTTRAVNHANTAKEVSFDVELPKTAFITNFTLTIDGVTYPGKVKEKEVAKKQYEKAVSQGKTAGLVKASGRKLEKFTVSVNVAAGSKVTFELTYEELLKRHKGKYEMYLKVQPKQLVKHFEITVDIFEPQGISTLDAEASFITNDLLGSALTKSFSGKKGHVSFKPSLDQQRSCPTCTDSLLKGDFIITYDVNRESPANVQIVNGYFVHFFAPQGLPVVPKSVVFVIDVSGSMHGRKMEQTKDALLKILEDVKQDDYLNFILFSGDVTTWKDSLVPATPENIQEASKFVMDIQDRGMTNINDALLRGISMLNKAREEHTVPERSTSIIIMLTDGDANVGESRPEKIQENVRNAIGGKFPLYNLGFGNNLNYNFLENMALENHGLARRIYEDSDANLQLQGFYEEVANPLLTGVEVEYPQNAILDLTQNSYQHFYDGSEIVVAGRLADEDMNSFKAAVKGHGAINDLTFTEEVDMKEMEKALQERDYIFGDYIERLWAYLTIEQLLDKRKNAQGEEKEILTAQALELSLKYHFVTPLTSMVVTKPEDNENQTAIANKPGEGPLDAEEVPSMAYLTSYQAPQTPYYYVDGDPHFIIQIPEKDDAICFNIDEDPGTVLRLIQDPVTGLTVNGQIIGEKTGRSDSQTRRTYFGKLGIASAQMDFRIEVTRENITLWNGDSLSTFSWLDTVMVTQDGLSVMINRKKNMVVSFGDGVTFVVVLHQVWKKEPAHHDFLGFYVVNSRGMSAQTHGLLGQFFHPFDFQVSDVHPGSDPTKPDATMVVKNHQLTVTRGSQKDYRKDISVGRNVACWFVHNNGQGLIDGIHRDYIVPNLF

SEQ ID NO: 315 - protein, 928 aa, Gallus gallus
  Chicken Interphotoreceptor matrix proteoglycan 1 SPACR Q8JIR8
MHLKTGLIFLAICLALQVQGSREIPSKTNHGEAKQLADASGSDKTERTTKRSRVSTIRRIFDMAKHRTKRSPFFSTGVKICPQESVKQILASHQAYYRLRVCQEAVWEAFRIFLDRIPDTSEYQNWVTACQRETFCIFDIGKNFSNSQEHLEIIQRRVKHRTFQERKDEISTDKTGGKKLEDIPSVSTGPPSASLSTYTLVPNGTLLNEIVNETKTPVKELGTNTVPELPAEQMVEFSVTLTDQEYTAELSDPNSPQYRQLAAKFQLQMQKIFEKLPGFKEIHVLGFKQKKEKDGSSSTIARYMVNFERDGSEIKSTADDISTIGSNKVENEKVPLSAKEEREISATKLTVTDLQQLVATALHEDRSLPVDLGTLRFTDEPIKPSSDFDNDIQGMVTIPLAGPDLDDTISAELPLVYPSPITVDQTRDIFVDEFTTGITDLSREIGGPEDFDSNFITSEPAFPTKPSREPPHDRSPDTEDITTDYQRFTVPFSALVSTDSPAKPEDSYLPPPADESDSNDLITDESPTEQVITPAVYTTGSFTLPTFLQATDKDTEAEMKKELVGVTEPLFKEADRDSLSGQAVKMMDELESSGDDILVTTSTYKTLPFLIGSSDLFATQPEVTFAAALPPDQTLLPTVTSPFYSHSVVIDQSPEVPDTLMPAAASALPDRASTGVQDIAAELDGAGVKSTAVLDEAEHGSGYISVQTTEPAEVTQAPTLKYVTTSSMTTAAKGKELVVFFSLRVTNMHFSDDLFNRSSQEYKALEQQFMQLLLPYLQSNLTGFKQLEILNFRNGSVIVNSKMKFARTVPYNITEAVHCVLEDFCDAAAQHLNLEIDSYSLDIEPADQADPCKFMACDEFSKCIMNEWTKEADCLCKPGYASQDGLPCRSLCEMEPHLCDNGGKCELVPGRGAVCRSPDQFTEPGLTS

SEQ ID NO: 316 - protein, 798 aa, Mus musculus
  Mouse Interphotoreceptor matrix proteoglycan 1 SPACR Q8RIW8
MNLQIKHAIFVLGIFLQVQGIKDTSIKIFSSEIKNIDKTPRIETIESTSTVHKVSTMKRIFDLPKLRTKRSALFPAANICPQESLRQILASLQEYYRLRVCQEVVWEAYRIFLDRIPDTEEYQDWVSLCQKETFCLFDIGKNFSNSQEHLDLLQQRIKQRSFPGRKDETASMETLEAPTEAPVVPTDVSRMSLGPFPLPSDDTDLKEILSVTLKDIQKPTTESKTEPIHVSEFSSEEKVEFSISLPNHRFKAELTNSGSPYYQELVGQSQLQLQKIFKKLPGFGEIRVLGFRPKKEEDGSSSTEIQLMAIFKRDHAEAKSPDSHLLSLDSNKIESERIHHGVIEDKQPETYLTATDLKKLIIQLLDGDLSLVEGKIPFGDEVTGTLFRPVTEPDLPKPLADVTEDATLSPELPFVEPRLEAVDREGSELPGMSSKDSSWSPPVSASISRSENLPSFTPSIFSLDAQSPPPLMTTGPTALIPKPTLPTIDYSTIRQLPLESSHWPASSSDRELITSSHDTIRDLDGMDVSDTPALSEISELSGYDSASGQFLEMTTPIPTVRFITTSSETIATKGQELVVFFSLRVANMPFSYDLFNKSSLEYQALEQRFTDLLVPYLRSNLTGFKQLEILSFRNGSVIVNSKVRFAKAVPYNLTQAVRGVLEDLRSTAAQGLNLEIESYSLDIEPADQADPCKLLDCGKFAQCVKNEWTEEAECRCRQGHESHGTLDYQTLNLCPPGKTCVAGREQATPCRPPDHSTNQAQEPGVKKLRQQNKVVKKRNSKLSAIGFEEFEDQDWEGN

SEQ ID NO: 317 - protein, 1243 aa, Mus musculus
  Mouse Interphotoreceptor matrix proteoglycan 2 SPACRCAN Q80XH2
MIMFLPVGRMSLGILILFLTGGNLVSASEERQEPMHAVSVLSPEKSTDLSLPTRKRQLLDATETGRRWLLRRRRSILFPNGVKICSSETVAEAVANHVKYFKARVCQEAIWEAFRTFWDRLPGRDEYRHWMNLCEDGVTSVFEMGAHFSQSVEHRNLIMKKLAYTREAESSSCKDQSCGPELSFPVPIGETSTLTGAVSSASYPGLASESSAASPQESISNEIENVTEEPTQPAAEQIAEFSIQLLGKRYSEELRDPSSALYRLLVEEFISEVEKAFTGLPGYKGIRVLEFRAPEENDSGIDVHYAVTFNGEAISNTTWDLISLHSNKVENHGLVEMDDKPTAVYTISNFRDYIAETLHQNFLMGNSSLNPDPKSLQLINVRGVLLPQTEDIVWNTQSSSLQVTTSSILDNTLQAEWLSADTTTTTTTTISPFGFSSSSPSATGRELQSQSALRDVVSTSKLASPTKVVLSSLPEILGGSSLTLHSVTPAVLQPDLPVAPEGRTSGSFILEDGLASTEELEDTSIDGLPSSPLIQPVPKETVPPMEDSDTALLSTPHLTSSAIEDLTKDIGTPSGLESLASNISDQLEVIPWFPDTSVEKDFIFESGLGSGSGKDVDVIDWPWSETSLEKTTKPLSKSWSEEQDALLPTEGREKLHIDGRVDSTEQIIESSEHRYGDRPIHFIEEESHVRSTIPIFVESATPPTSPIFSKHTSDVPDIDSYSLTKPPFLPVTIAIPASTKKTDEVLKEDMVHTESSSHKELDSEVPVSRPDMQPVWTMLPESDTVWTRTSSLGKLSRDTLASTPESTDRLWLKASMTQSTELPSTTHSTQLEEEVIMAVQDISLELDQVGTDYYQSELTEEQHGKADSYVEMSTSVHYTEMPIVALPTKGGVLSHTQTAGALVVFFSLRVTNMLFSEDLFNKNSLEYKALEQRFLELLVPYLQSNLSGFQNLEILSFRNGSIVVNSRVRFAESAPPNVNKAMYRILEDFCTTAYQTMNLDIDKYSLDVESGDEANPCKFQACNEFSECLVNPWSGEAKCKCYPGYLSVDELPCQSLCDLQPDFCLNDGKCDIMPGHGAICRCRVGSNWWYRGQHCEEFVSEPFVIGITIASVVSFLLVASAVVFFLVKMLQAQNVRRERQRPTSSSRHPDSLSSVENAMKYNPAYESHLAGCELYEKSYSQHPFYSSASEEVIGGLSREEIRQMYESSDLSKEEIQERMRILELYANDPEFAAFVREHQMEEL

SEQ ID NO: 318 - protein, 1241 aa, Rattus norvegicus
  Rat Interphotoreceptor matrix proteoglycan 2 SPACRCAN P70628
MIMFLPLGRISLGILILFLTGGNLVSVSEEIQDRMHAVAVLSPKESTDLSLPTRKRQLLDATETGRRWPLRRRRSILFPNGVRICPSDTVAEAVANHVKYFKARVCQEAIWEAFRTFWDRLPGREEYQYWMNLCEDGVTSVFEMGTQFSQSVEHRHLIMEKLTYTKEAESSSCKDQACGPELSSPVPIGETSTLAGAVSSASYPGAASERSAASPQESISNEIENVTEQPTPPAAEQIAEFSIQLLGKQYSEELRDPSSALYRLLVEEFISEVEKAFTGLPGYKGIHVLDFRSPKENGSGIDVHYAVTFNGEAISNTTWDLISLHSNKVENHGLVELDDKPTAVYTISNFRDYIAETLHQNFLMGNSSLNPDPKSLQLINVRGVLLPQTEEIVWNTQSSSLQVTTSSILDNTLQAEWLSADESITTTTTTTISPFGFSSGPPSATGRELHSESTLGDIVSTPKLASPSKVVLSSSPEVLGGSSLTLHSVTPAVLQIDLPVAPEGRTSGSSILEDDNTEESEDVSIDVLPSSSLIQPVPKETVPPMEDSDMILLTSSPHLTSSVIEDLAKDITTPSGLDSLASRVSDKLDVSPWFPDTSVEKEFIFESGLGSGSGKNVDVIDWPWSETSLEKTTEPLSKSWSEEQDTLLPTESIEKLHMYFTEQMIEPSAHRYGDGPIYFTEEESHVRSTIPIFAESATQPTSLISSKHTSDVPDIDSYSVTKAPFLLATIANTASTKETDEVNTLLKKGMVQTEPSSPKGLDSKISVARPDMQPVWTILPESDTVWARTSSLGKLSRDTLVSTPESADRLWLKASMTQPAELPPSTHSIQLEDEVIMAVQNISLELDQVGTDYYQPELTQEQNGKVDSYVEMPTHVHYTEMPLVAQPTKGGVLSRTQTAGALVVFFSLRVTNMLFSEDLFNKNSLEYKALEQRFLELLVPYLQSNLSGFQNLEILNFRNGSIVVNSRVKFAESVPPNVNNAIYMILEDFCTTAYQTMNLDIDKYSLDVESGDDANPCKFQACNEFSECLVNPWSGEAKCKCHPGYLSVDELPCQSVCDLQPDFCLNDGKCDVMPGHGAICRCRVGSNWWYRGQHCEEFVSEPFVIGITIASVVSLLLVASAVVFFLAKMLQAQNVRRERQRPTNRQPDSLSSVENAMKYNPAYESRLAGCEQYEKPYSQHPFYSSASEEVIGGLSREEIRQMYESSDLSKEEIQERMRILELYANDPEFAAFVREHEMEEL

SEQ ID NO: 319 - protein, 1423 aa, Gallus gallus
  Chicken Interphotoreceptor matrix proteoglycan 2 SPACRCAN Q1XI86
  VARIANT 491, 606, 623, 812, 842: Xaa = any amino acid
MFAFLWKISLCLLVLGVITGDPQAVAAEEKQAKDASPTPQLGVWQFASPSLPPELRKLHGIVEAEQVNRHLLRRRKRSILFPSGVKICPDESVEQAIANHLKYFRLRVCQETVWEVFKTFWDRLPEREEYHTWMSLCEEGTMSIFEMGMNFSQSEEHRSLIVKKLSYTKEAMAGSCTDWSCGGTPTPASDADATTLRDAAANVPPPHEVSIESPPGGTSHEIEDADTTINNEIKKEDEIPVRPVTEQMIEFSIVIAGEKYSEELSDPDTAKYQLLSEQFVSQIQNVFEGLPGYKNIHVLEFSSPEEDSGVEVHYAVTFDGEAISNATWDLINLHSNKVEDNSFMGIEDNPTVVYTISDFQDYIAEILQKNALLENTSLTLDPNSLQLINVKEILHPTQEDPSWITEHPTVLEHVEFDDNTFSAERPSADESTVSNTLPFDFTKPDSTLDSEESDDNEIRPRPESLDSEVSLIPEAPLSSEADVTSLPDGLXLADWNQTPALVTAPVIEHDSLDSLEWLSAPDSSDEFEDTGLSDDFLLPSSPSSHLVPEEPPSTDDYTAPLLSAPTVASSSVIETDTKRTVTAEKEVVTQGSPADSSSADSLLHEXVEESPFPLEVHPVEGEXDIYLGDRMIFDDGSGSAFDGSGKGMEPSIWPWDVATLEPVFYPGPDSWLDDDNDSLPFRTEDIPEGLILDYILNSGNKLDDDPSKDENEGVASIKENFLDESEIFVFPETTTQQVPLLQTGEPSSVETSTQMETLSMDDDSFVKPSFVLEPPEDYSFADLPTGEDLFLPHSTGVSVEDTLLTSTVTLGXEDSLLTSTVAFSVEQPEESSVGQEIISEAXEHQNEDRPTVEELFTAGQSNVGEAATVGYLDKSSLETVLTAEPFEVSTDTSTEEQQSLDSSLADRDTGLAIRKPADVWPTDRVLEKTLDQTVQSAVPTAAQVSTAVPSLIHQATALEGFAGQDGTEHDTHVSMSISTILNSYVTITADTVELPSHLPPMTTTVSSSVVTLAKVGDETTRVLDVSVDLDHVSMVSFSPEPSEEAKSMTDSHMELTTHAHSTEMAGVAWPTHEIHNSTPVPSRALVVFFSLRVTNMMFSEDLFNKNSPEYKALEQRFLELLVPYLQSNLTGFQNLEILNFRNGSIVVNSRMKFAKPVPRNVTNAVYMILEDFCNTAYHTMNLAIDKYSLDVESGEQADPCKFQACNEFSECLVNRWSGEAECVCNPGYLSIDGLPCNSICDLQPNFCLNDGKCDISPGQGAICRCRVGENWWYRGEHCEEYVSEPLVVGIAIASVAGFLLVASAVIFFLARTLRDQYTKSDTEDSQGQGDSLSSIENAVKYNPMYESDTTGYSHYYRRYPQLTSYSSTSAETSTDYSSEEIRHIYENSELTKEEIQDRIRIIELYAKDRQFAEFVRQHQMKLL

SEQ ID NO: 320 - protein, 304 aa, Mus musculus
  Mouse CD38 P56528
MANYEFSQVSGDRPGCRLSRKAQIGLGVGLLVLIALVVGIVVILLRPRSLLVWTGEPTTKHFSDIFLGRCLIYTQILRPEMRDQNCQEILSTFKGAFVSKNPCNITREDYAPLVKLVTQTIPCNKTLFWSKSKHLAHQYTWIQGKMFTLEDTLLGYIADDLRWCGDPSTSDMNYVSCPHWSENCPNNPITVFWKVISQKFAEDACGVVQVMLNGSLREPFYKNSTFGSVEVFSLDPNKVHKLQAWVMHDIEGASSNACSSSSLNELKMIVQKRNMIFACVDNYRPARFLQCVKNPEHPSCRLNT

SEQ ID NO: 321 - protein, 303 aa, Rattus norvegicus
  Rat CD38 Q64244
MANYEFSQVSEDRPGCRLTRKAQIGLGVGLLLLVALVVVVVIVLWPRSPLVWKGKPTTKHFADIILGRCLIYTQILRPEMRDQDCKKILSTFKRGFISKNPCNITNEDYAPLVKLVTQTIPCNKTLFWSKSKHLAHQYTWIQGKMFTLEDTLLGYIADDLRWCGDPSTSDMNYDSCPHWSENCPNNPVAVFWNVISQKFAEDACGVVQVMLNGSLSEPFYRNSTFGSVEVFNLDPNKVHKLQAWVMHDIKGTSSNACSSPSINELKSIVNKRNMIFACQDNYRPVRFLQCVKNPEHPSCRLNV

SEQ ID NO: 322 - protein, 298 aa, Oryctolagus cuniculus
  Rabbit CD38 Q0MZ03
MPDYEFSPASGDRPRSWISKQVLIVLGVCLPVILALAIWVGVLTWRQSSMGATDHVSAIVLGRCLTYTRNMHPELRNQDCKKILNTFTSAFVSKDPCNITKEDYQPLIDLVTQTVPCNKTLFWSRSKELAHQYSGIQKEMFTLEDTLLGYIADNLVWCGDPRTSEVKEEFCPYRNENCSSTATSVFWTVVSQKFAESACGTVYVMLNGSRTTAFSKASTFGSVEVFNLHPDRVHTLHAWVMHDIGGVERDSCLGSSIKELKSIVNQRNISFFCQDDYRPARFVQCVRHPEHPSCSVLM

SEQ ID NO: 323 - protein, 301 aa, Macaca fascicularis
  Cynomolgus monkey CD38 Q5VAN0
MANCEFSPVSGDKPCCRLSRRAQVCLGVCLLVLLILVVVVAVVLPRWRQQWSGSGTTSRFPETVLARCVKYTEVHPEMRHVDCQSVWDAFKGAFISKYPCNITEEDYQPLVKLGTQTVPCNKTLLWSRIKDLAHQFTQVQRDMFTLEDMLLGYLADDLTWCGEFNTFEINYQSCPDWRKDCSNNPVSVFWKTVSRRFAETACGVVHVMLNGSRSKIFDKNSTFGSVEVHNLQPEKVQALEAWVIHGGREDSRDLCQDPTIKELESIISKRNIRFFCKNIYRPDKFLQCVKNPEDSSCLSGI

SEQ ID NO: 324 - protein, 411 aa, Mus musculus
  Mouse Intracellular hyaluronan-binding protein 4 Q9JKS5
MKGALGSPVAAAGAAMQETFGCVVANRFHQLLDDESDPFDILREAEHRRQQQLQRKRRDEAAAASGAGHRGGRSPAVASGHRPGAGGRRESQKERKSLAASGAQQPDSPGGPQPPGQKRTPRRGEQQGWNDNRGTDVVLERAERRSYREYRPYETERQADLPVEKFTDEKPVDRFDRDRPLRGRGGPRGGLRSRGRGGPGNRAFDSFDQRGKRDFERYSSNDKTNRMEDSMGGCGIRPWGSGKDTSDTEPPAPMEETSMMEECQGTLDEESAAKVPELEVEEENQVQEMTLDEWKNLQEQTRPKPEFNIRKPESTVPSKAVVIHKSRYRDDMVKEDYEDESHVFRKAANDITSQLEINFGNLPRPGRGARGSTRGGRGRMRRTENYGPRAEVVTQDVAPNPDDPEDFPALA

SEQ ID NO: 325 - protein, 357 aa, Gallus gallus
  Chicken Intracellular hyaluronan-binding protein 4 Q9I9R0
MMKGAMGCPVAAVMEGSFSCTVANRFYQLLDDESDPFDNLREAERCWQQRKNLSKVVARRGDPGSRGCATRRELQKQRKQLGTPAPPPQPGQKQAPKQEECGGKDNSRAEKEHKTAWRPSFMEYLSSETESQAELTAQSLFRPTAKLNYERPRGCGRGRGGMQGRGRGGGINKSFDGFDQRGKREFGRQNDNDKIEMELTAPMEATAKTAKSPGVSEGELLNKVAEGKPREEVVQEMTLDEWKNLQQQNRPKHEFNIRRPESTVPSKAVVIHKSKYSDDIQKGELEDDYHIFRRAVNDITFQLDINFGSLPRPGCGSRGARGRGRGRQMEETGPQPEAMVQIVAPNPDDPEDFPALT

SEQ ID NO: 326 - protein, 506 aa, Saccharomyces cerevisiae
  Saccharomyces cerevisiae Baker's yeast CDC37 P06101
MAIDYSKWDKIELSDDSDVEVHPNVDKKSFIKWKQQSIHEQRFKRNQDIKNLETQVDMYSHLNKRVDRILSNLPESSLTDLPAVTKFLNANFDKMEKSKGENVDPEIATYNEMVEDLFEQLAKDLDKEGKDSKSPSLIRDAILKHRAKIDSVTVEAKKKLDELYKEKNAHISSEDIHTGFDSSFMNKQKGGAKPLEATPSEALSSAAESNILNKLAKSSVPQTFIDFKDDPMKLAKETEEFGKISINEYSKSQKFLLEHLPIISEQQKDALMMKAFEYQLHGDDKMTLQVIHQSELMAYIKEIYDMKKIPYLNPMELSNVINMFFEKVIFNKDKPMGKESFLRSVQEKFLHIQKRSKILQQEEMDESNAEGVETIQLKSLDDSTELEVNLPDFNSKDPEEMKKVKVFKTLIPEKMQEAIMTKNLDNINKVFEDIPIEEAEKLLEVFNDIDIIGIKAILENEKDFQSLKDQYEQDHEDATMENLSLNDRDGGGDNHEEVKHTADTVD

SEQ ID NO: 327 - protein, 389 aa, Drosophila melanogaster
  Fruit fly CDC37 Q24276
MVDYSKWKNIEISDDEDDTHPNIDTPSLFRWRHQARVERMAEMDHEKDELKKKRQSYQARLMDVKERISKKDGDEEALKKELEKIEAEGKELDRIESEMIKKEKKTPWNVDTISKPGFEKTVINKKAGRKPDENLSEEEREQRMKQFVKENEKLCQQYGMLRKYDDSKRFLQEHLHLVGEETANYLVIWSINLEMEEKHELMAHVAHQCICMQYILELAKQLDVDPRACVSSFFSKIQHCHPEYRAQFDSEIEGFKGRIQKRAQEKIQEAIAQAEEEERKERLGPGGLDPADVFESLPDELKACFESRDVELLQKTIAAMPVDVAKLHMKRCVDSGLWVPNAADLEGDKKEEDDSDDVAGGEEKTDDAKSESAAKEEPIYTGVSTEDVD

SEQ ID NO: 328 - protein, 379 aa, Rattus norvegicus
  Rat CDC37 Q63692
MVDYSVWDHIEVSDDEDETHPNIDTASLFRWRHQARVERMEQFQKEKEELDRGCRECKRKVAECQRKLKELEVAEGGGQVELERLRAEAQQLRKEERSWEQKLEDMRKKEKNMPWNVDTLSKDGFSKSMVNTKPEKAEEDSEEAREQKHKTFVEKYEKQIKHFGMLHRWDDSQKYLSDNVHLVCEETANYLVIWCIDLEVEEKCALMEQVAHQTMVMQFILELAKSLKVDPRACFRQFFTKIKTADQQYMEGFKYELEAFKERVRGRAKLRIEKAMKEYEEEERKKRLGPGGLDPVEVYESLPEELQKCFDVKDVQMLQDAISKMDPTDAKYHMQRCIDSGLWVPNSKSGEAKEGEEAGPGDPLLEAVPKAGNEKDISA

SEQ ID NO: 329 - protein, 379 aa, Mus musculus
  Mouse CDC37 Q61081
MVDYSVWDHIEVSDDEDETHPNIDTASLFRWRHQARVERMEQFQKEKEELDRGCRECKRKVAECQRKLKELEVAESDGQVELERLRAEAQQLRKEERSWEQKLEDMRKKEKNMPWNVDTLSKDGFSKSMVNTKPEKAEEDSEEAREQKHKTFVEKYEKQIKHFGMLHRWDDSQKYLSDNVHLVCEETANYLVIWCIDLEVEEKCALMEQVAHQTMVMQFILELAKSLKVDPRACFRQFFTKIKTADHQYMEGFKYELEAFKERVRGRAKLRIEKAMKEYEEEERKKRLGPGGLDPVEVYESLPEELQKCFDVKDVQMLQDAISKMDPTDAKYHMQRCIDSGLWVPNSKSGEAKEGEEAGPGDPLLEAVPKAGNEKDVSA

SEQ ID NO: 330 - protein, 466 aa, Schizosaccharomyces pombe
  Fission yeast CDC37 O94740
MAIDYSKWDKLELSDDSDIEVHPNVDKKSFIRWRQRDIHEKRAVRKQKMEDIKGAMAMNRRLLSRISEMETVLEKESPSDPYVLLGSFLEAKKSEDMDSAIPGGMSYHHMLMSLLKVIKDAEDTTEEKSMDDSDKCLRRLKSHKERLLKLLEDAQKEYDTLEAESKNYITSEDLHLGFDSTYVQKKEPEKPKKTKTKKETIQVIESLNNPTPPTDFPGAKEQASTGNAPKNPVNENESEDEEGLSLSEDGKKFANIDFGDYSSSEEFLKEHLNILADEEESDAILLEAFNAELEGKPSLAKQYVHQALLISYCRQLGPNGLSIFFQKIKDPNHQSQRLFLEDVHNTYVRIHERSAAISKEQAESGEGVEQIQLCAVDPNTKLSITIPEAGSTDPETQKARAAFESFPPNLQKALMTNDLDKINVVLGKMAVENAEEVVEKLSSTGMLSIEEGIIDTTKGETIPQLS

SEQ ID NO: 331 - protein, 399 aa, Drosophila virilis
  Drosophila virilis Fruit fly CDC37 Q24740
MVDYSKWKNIEISDDEDETHPNIDTPSLFRWRHQARVERMAESEKEKEELKKKRQSYQARLINVKELISKKEGDEVALKKELEKIENEGKELDRQENELLKREKKTPWNVDTISKPGFEKTVINKKPPRKAAEDLTEEEREQRMKQFVKENEKLCKQYGMLRKYDDSKRFLQEHLDLVCEETANYLVIWSINLEMEEKHDLMAHVAHQCICMQYILELAKQLDVDPRACVSSFFSKIQQCVPEYRQQFESEIEGFKERIQKRAQEKLQEAMAQLEEEEKQERMGPGGLDPADVFESLPEELKACFESRDIELLQKTIATMPVDQAKYHMKRCVDSGLWVPNAADVQLGNDETEAKDDETTTATNETPTEKENSKSQNEKSADAAKEEPLYAGVSTDDVD

SEQ ID NO: 332 - protein, 393 aa, Gallus gallus
  Chicken CDC37 Q57476
MVDYSVWDHIEVSDDEDETHPNIDTASLFRWRHQARVERMEQFQKEKEELDKGCRECKRKLAECQKKLKELEVAEPGGGSGGGRGERERLQAEAQQLRHEERNWESKMEELRKKEKNMPWNVHTLSKDGFSKSVFNVKAEEKEETEEQKEQKHKTFVERHEKQIKHFGMLRRWDDSQKYLSDNPHLVCEETANYLVIWCIDLEVEEKQALMEQVAHQTIVMQFILELAKSLKVDPRACFRQFFTKIKTADQQYMEGFNDELEAFKERVRGRAKARIERAMREYEEEERQKRLGPGGLDPVDVYESLPPELQKCFDAKDVQMLQDTISRMDPTEAKYHMQRCIDSGLWVPNAKAAAEGGGQGGAHGQPGGADSEALYEEIPKESGEEEGGEGKA

SEQ ID NO: 333 - protein, 380 aa, Bos taurus
  Cow CDC37 Q5EAC6
MVDYSVWDHIEVSDDEDETHPNIDTASLFRWRHQARVERMEQFQKEKEELDRGCRECKRKVAECQRKLKELEVAEGEGGKAELERLQAEAQQLRKEERSWEQKLEEMRKKEKSMPWNVDTLSKDGFSKSMVNTKPEQAEEESEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKDRVRGRAKLRIEKAMKEYEEEERKKRLGPGGLDPVEVYESLPEELQKCFDAKDVQMLQDAISKMDPTDAKYHMQRCIDSGLWVPNSKSSEAKDGEEAGTGDPLLEATSKSGDEKDVSV

SEQ ID NO: 334 - protein, 508 aa, Candida albicans
  Candida albicans Yeast CDC37 Q8X1E6
MPIDYSKWDKIEISDDSDVEVHPNVDKQSFIRWKQRDIHEKRMQRNIEIKSILIQLTMYAKLNERVDYLLEKLTSTELLDSEKVMSKLNSEFDPQEKFDYDKLIKDKGSTLRKGLKDLKFDREEIENTPCYNEMIEDLFVQIKDDHPETKTDGDKLIEYLKEHRNRIDDVLSKQTIKLDDLLYQKAQLIVSDDLHTGFDRSFLNKDKPEEKEENQDKPKAPEAKKTTVTTTETINSPKPVEENTDKEILDELEILPATKEFAKIPSDNLSKAAEFLIKHPSICTEQQKDALIMTAFDLQLENKSDEAKHIVHQSLLLQYVGQLSDNGKAAPANVINAIKLFFSKIAAESSPAKHAFLEDVNQTFNHIKGRCEIIKEEQKQNAANKEGTGEEEEEEALIQLKALDDNTELSVNIPQEGTKEYEIFTTKLPIEFQNAIKTESIDEVNKEFAKLKIEDAERILEIFNECGVIGISGYIEDEKEFEELKKEYAHETANQEEDQSASVEDTVD

SEQ ID NO: 335 - protein, 370 aa, Caenorhabditis elegans
  Caenorhabditis elegans CDC37 O02108
MPIDYSKWKDIEVSDDEDDTHPNIDTPSLFRWRHQARLERMAEKKMEQEKIDKEKGTTSKKMEELEKKLAAADVTDKSDIQKQIDEVKAQEEAWRKKEAELEEKERLEPWNVDTIGHEAFSTSRINKITEKKPQAPKTDEEDTHAMSTFFETHESLLEKMAVLKNGAKSTELFLAEHPHMASEYTANWLTIEALNAAIDFNEEKMKTMAEQCIIIQYLLELSKSLNAVATNTTVQKQFFKKFEAAEPVYMKHYQDEVKAFEDRLRTRAQTKRDAAMEEAEAEEKAERMKSAPGGIDPQEVFEQLPEEMRKCFEAHDIEALKGVAQKMDEEVFKYHFDRCIASGLWVPGKADDDDDDEEAAPAEEEPTTSS

SEQ ID NO: 336 - protein, 377 aa, Tetraodon fluviatilis
  Tetraodon fluviatilis Green pufferfish CDC37 Q9DGQ7
MSRIDYSVWDHIEVSDDEDVSHPNIDTPSLFRWRHQARVERMEDFKKKGDDLNKGLQECRRKLAEAQKKVRELSISAAGDAKAELTKTQTEEKKLKKEERDWARKLEEHNHEEKKMPWNVDTLSKDGFSKSIVNVKADSAEDTEEEKEKKHKTFVERYEKQIKHFGMLHRWDDSQRYLSDNPDLVCEETANYLVIMCIDLEVEEKHALMEQVAHQTIVMQFILELAKSLKVDPRGCFRQFFEKIKTADQQYQDAFNDELESFKERVRGRAKIRIEKAMKEYEEEERQKRLGPGGLDPVEVYESLPPEMQKCFDEKDIQMLQDVITKMDPTEAKAHMKRCIDSGLWVPNSKMDESDEKEDGSTYEEVKQEQEEPAKKE

SEQ ID NO: 337 - protein, 558 aa, Mus musculus
  Mouse Hyaluronan-binding protein 2 Q8K0D2
MFVRMLVFRVLLLIALVGKSVIGLSLMSFIAPPDPDWTPDDYYYSYEQSSPDEDPSVTQTTPENPDWYYEDDDPCQSNPCEHGGDCIIRGDTFSCSCPAPFSGSRCQTAQNKCKDNPCVHGDCLITQKHPYYRCACKYPYTGPDCSKVLPACRPNPCQNGGVCSRHRRRSRFTCACPDQYKGKFCEIGPDDCYVGDGYSYRGKVSKTVNQNPCLYWNSHLLLQETYNMFMEDAETHGIAEHNFCRNPDGDHKPWCFVKVNSEKVKWEYCDVTVCPVPDTPNPVESLLEPVMELPGFESCGKTEVAEHAVKRIYGGFKSTAGKHPWQVSLQTSLPLTTSMPQGHFCGGALIHPCWVLTAAHCTDINTKHLKVVLGDQDLKKTESHEQTFRVEKILKYSQYNERDEIPHNDIALLKLKPVGGHCALESRYVKTVCLPSDPFPSGTECHISGWGVTETGEGSRQLLDAKVKLIANPLCNSRQLYDHTIDDSMICAGNLQKPGSDTCQGDSGGPLTCEKDGTYYVYGIVSWGQECGKKPGVYTQVTKFLNWIKTTMHREAGL

SEQ ID NO: 338 - protein, 558 aa, Rattus norvegicus
  Rat Hyaluronan-binding protein 2 Q6L711
MSVVMLVFRVLLLIALVGNSAIGLSLMPFIAPPDPDWTPDDYYYSYEQSSPDKDASVTQTSPENPDWYYEDDDPCQSNPCEHGGDCIIRGNTFSCSCPAPFSGSRCQTVQNKCKDNPCVQGDCLITQTPPYYRCACKYPYTGPDCSKVLPVCRPNPCQNGGVCSRHRRRSRFSCACPDQYKGRFCEIGPDDCYVGDGYSYRGKVSRTVNQNPCLYWNSHLLLQENYNMFMEDAETHGIADHNFCRNPDGDHKPWCFVKVNSEKVKWEYCNVEVCPESDAANPVGSLQEPVMELPGFDSCGKTEMTEHAVKRIYGGFKSTAGKHPWQVSLQTSLPLTTSMPQGHFCGGSLIHPCWVLTAAHCTDMSTKHLKVVLGDQDLKKTESHEQTFRVEKILKYSQYNERDEIPHNDIALLKLKPVGGHCALESKYVKTVCLPSDPFPSGTECHISGWGVTETGEGSRQLLDAKVKLIANALCNSRQLYDHTIDDSMICAGNLQKPGSDTCQGDSGGPLTCEKDGTYYVYGIVSWGQECGKKPGVYTQVTKFLNWIKTTMHKEAGL

SEQ ID NO: 339 - protein, 558 aa, Bos taurus
  Cow Hyaluronan-binding protein 2 Q5E9Z2
MFARMSDLHVLLLMVLAGKTAFGLSLLSFLTEPDPDWTPDQYEYSQEYNNQEENASSTTAYSDNPDWYYEEDDPCLSNPCTHGGDCLVSGATFTCRCPDPFSGNRCQNVQNKCKNNPCGRGDCLITQSPPYHRCACKHPYRGSDCSRVVPVCRPNPCQNGGTCSRQRRRSKFTCACPDQFKGKLCEIGPDDCYVDDGYSYRGRVSKTIHQHTCLYWNSHLLLQEKYNMFMEDAEAHGIGEHNFCRNPDGDKKPWCFIKVNNVKVKWEYCDVPACSALDVANPEGRPTEPLTKFPEFGSCGRTEIAEKKVKRIFGGFKSTAGKHPWQASLQTSLRLTVSTPQGHYCGGALIHPCWVLTAAHCTEIKTKYLKVVLGDQDLTKTEFHEQSFGVQKIFKYSHYIEIDDIPYNDIALLKLKPVDGHCALESKYVKTVCLPDGPFLSGTECYISGWGVTETGEGSRHLLDAKVKLISNTICNSRQLYDHSIDDNMICAGNLQKPGQDSCQGDSGGPLTCEKDGTSYIYGIVSWGLECGKRPGVYTQVTKFLTWIKATMEKEASF

SEQ ID NO: 340 - protein, 2315 aa, Homo sapiens
  human Phosphacan NP_002842
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDDRGSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 341 - protein, 159 aa, Homo sapiens
  CD44 Hyaluronan-binding domain
AQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDV

SEQ ID NO: 342 - protein, 5 aa, Artificial Sequence
  linker
GGGGG

SEQ ID NO: 343 - protein, 5 aa, Artificial Sequence
  linker
GGGGS

SEQ ID NO: 344 - protein, 5 aa, Artificial Sequence
  linker
SSSSG

SEQ ID NO: 345 - protein, 12 aa, Artificial Sequence
  linker
GKSSGSGSESKS

SEQ ID NO: 346 - protein, 15 aa, Artificial Sequence
  linker
GGSTSGSGKSSEGKG

SEQ ID NO: 347 - protein, 19 aa, Artificial Sequence
  linker
GSTSGSGKSSSEGSGSTKG

SEQ ID NO: 348 - protein, 18 aa, Artificial Sequence
  linker
GSTSGSGKPGSGEGSTKG

SEQ ID NO: 349 - protein, 14 aa, Artificial Sequence
  linker
EGKSSGSGSESKEF

SEQ ID NO: 350 - protein, 4 aa, Artificial Sequence
  linker
AAPA

SEQ ID NO: 351 - DNA, 27 bp, Artificial Sequence
  Gly4Ser with NcoI ends
ccatgggcggcggcggctctgccatgg

SEQ ID NO: 352 - DNA, 42 bp, Artificial Sequence
  (Gly4Ser)2  with NcoI ends
ccatgggcggcggcggctctggcggcggcggctctgccatgg

SEQ ID NO: 353 - DNA, 75 bp, Artificial Sequence
  (Ser4Gly)4 with NcoI ends
ccatggcctcgtcgtcgtcgggctcgtcgtcgtcgggctcgtcgtcgtcgggctcgtcgtcgtcgggcgccatgg

SEQ ID NO: 354 - DNA, 45 bp, Artificial Sequence
  (Ser4Gly)2  with NcoI ends
ccatggcctcgtcgtcgtcgggctcgtcgtcgtcgggcgccatgg

SEQ ID NO: 355 - protein, 330 aa, Homo sapiens [sequence omitted]

SEQ ID NO: 356 - protein, 326 aa, Homo sapiens
  hIgG2 heavy chain constant
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 357 - protein, 377 aa, Homo sapiens
  hIgG3 heavy chain constant
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 358 - protein, 327 aa, Homo sapiens
  hIgG4 heavy chain constant
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 359 - protein, 231 aa, Artificial Sequence
  hIgG1 Fc
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 360 - protein, 93 aa, Homo sapiens
  TSG-6 Link domain
GVYHREARSGKYKLTYAEAKAVCEFEGGHLATYKQLEAARKIGFHVCAAGWMAKGRVGYPIVKPGPNCGFGKTGIIDYGIRLNRSERWDAYCY

SEQ ID NO: 361 - protein, 93 aa, Homo sapiens
  TSG-6 Link domain variant K20A/K34A/K41A
GVYHREARSGKYKLTYAEAAAVCEFEGGHLATYAQLEAARAIGFHVCAAGWMAKGRVGYPIVKPGPNCGFGKTGIIDYGIRLNRSERWDAYCY

SEQ ID NO: 362 - protein, 39 aa, Artificial Sequence
  c-jun leucine zipper
RIARLEEKVKTLKAQNSELASTANMLREQVAQLKQKVMN

SEQ ID NO: 363 - protein, 39 aa, Artificial Sequence
  c-fos leucine zipper
LTDTLQAETDQLEDEKSALQTEIANLLKEKEKLEFILAA

SEQ ID NO: 364 - protein, 33 aa, Artificial Sequence
  GCN4 leucine zipper
RMKQLEDKVEELLSKNYHLENEVARLKKLVGER

SEQ ID NO: 365 - protein, 33 aa, Artificial Sequence
  GCN4 leucine zipper- trimer
RMKQIEDKIEEILSKIYHIENEIARIKKLIGER

SEQ ID NO: 366 - protein, 33 aa, Artificial Sequence
  GCN4 leucine zipper- tetramer
RMKQIEDKLEEILSKLYHIENELARIKKLLGER

SEQ ID NO: 367 - protein, 44 aa, Artificial Sequence
  R subunit of protein kinase A (PKA)
SHIQIPPGLTELLQGYTVEVLRQQPPDLVEFAVEYFTRLREARA

SEQ ID NO: 368 - protein, 17 aa, Artificial Sequence
  AD subunit
QIEYLAKQIVDNAIQQA

SEQ ID NO: 369 - protein, 45 aa, Artificial Sequence
  modified R subunit of protein kinase A (PKA)
CSHIQIPPGLTELLQGYTVEVLRQQPPDLVEFAVEYFTRLREARA

SEQ ID NO: 370 - protein, 21 aa, Artificial Sequence
  modified AD subunit
CGQIEYLAKQIVDNAIQQAGC

SEQ ID NO: 371 - protein, 93 aa, Homo sapiens
  Stabilin-1 Link domain
GVFHLQATSGPYGLNFSEAEAACEAQGAVLASFPQLSAAQQLGFHLCLMGWLANGSTAHPVVFPVADCGNGRVGIVSLGARKNLSERWDAYCF

SEQ ID NO: 372 - protein, 93 aa, Homo sapiens
  Stabilin-2 Link domain
GVFHLRSPLGQYKLTFDKAREACANEAATMATYNQLSYAQKAKYHLCSAGWLETGRVAYPTAFASQNCGSGVVGIVDYGPRPNKSEMWDVFCY

SEQ ID NO: 373 - protein, 93 aa, Homo sapiens; identical to SEQ ID NO: 372
  CAB61358 Link domain

SEQ ID NO: 374 - protein, 95 aa, Homo sapiens
  KIAA0527 Link domain
KLFVLESQNGSQGLQLEAARLSCKSRGAHLASADELRRVVQDCSFAVCTTGWLADGTLGTTVCSKGSGEQQIMRAVDVRIESNPVPGGTYSALCI

SEQ ID NO: 375 - protein, 88 aa, Homo sapiens
  CD44 Link domain
GVFHVEKNGRYSISRTEAADLCKAFNSTLPTMAQMEKALSIGFETCRYGFIEGHVVIPRIHPNSICAANNTGVYILTSNTSQYDTYCF

SEQ ID NO: 376 - protein, 90 aa, Homo sapiens
  LYVE-1 Link domain
GITLVSKKANQQLNFTEAKEACRLLGLSLAGKDQVETALKASFETCSYGWVGDGFVVISRISPNPKCGKNGVGVLIWKVPVSRQFAAYCY

SEQ ID NO: 377 - protein, 95 aa, Homo sapiens
  HAPLN1 Link domain 1
VVFPYFPRLGRYNLNFHEAQQACLDQDAVIASFDQLYDAWRGGLDWCNAGWLSDGSVQYPITKPREPCGGQNTVPGVRNYGFWDKDKSRYDVFCF

SEQ ID NO: 378 - protein, 92 aa, Homo sapiens
  HAPLN1 Link domain 2
GRFYYLIHPTKLTYDEAVQACLNDGAQIAKVGQIFAAWKILGYDRCDAGWLADGSVRYPISRPRRRCSPTEAAVRFVGFPDKKHKLYGVYCF

SEQ ID NO: 379 - protein, 94 aa, Homo sapiens
  HAPLN2 Link domain 1
VVFPYQPSRGRYQFNYYEAKQACEEQDGRLATYSQLYQAWTEGLDWCNAGWLLEGSVRYPVLTARAPCGGRGRPGIRSYGPRDRMRDRYDAFCF

SEQ ID NO: 380 - protein, 90 aa, Homo sapiens
  HAPLN2 Link domain 2
GQFFVPGRLTLSEAHAACRRRGAVVAKVGHLYAAWKFSGLDQCDGGWLADGSVRFPITTPRPRCGGLPDPGVRSFGFPRPQQAAYGTYCY

SEQ ID NO: 381 - protein, 95 aa, Homo sapiens
  APLN3 Link domain 1
VVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCF

SEQ ID NO: 382 - protein, 92 aa, Homo sapiens
  HAPLN3 Link domain 2
GRVYYLEHPEKLTLTEAREACQEDDATIAKVGQLFAAWKFHGLDRCDAGWLADGSVRYPVVHPHPNCGPPEPGVRSFGFPDPQSRLYGVYCY

SEQ ID NO: 383 - protein, 105 aa, Homo sapiens
  HAPLN4 Link domain 1
VVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCF

SEQ ID NO: 384 - protein, 92 aa, Homo sapiens
  HAPLN4 Link domain 2
GRVFFLKPLRPVPFSGAARACAARGAAVAKVGQLFAAWKLQLLDRCTAGWLADGSARYPIVNPRARCGGRRPGVRSLGFPDATRRLFGVYCY

SEQ ID NO: 385 - protein, 95 aa, Homo sapiens
  Aggrecan Link domain 1
IVFHYRAISTRYTLDFDRAQRACLQNSAIIATPEQLQAAYEDGFHQCDAGWLADQTVRYPIHTPREGCYGDKDEFPGVRTYGIRDTNETYDVYCF

SEQ ID NO: 386 - protein, 96 aa, Homo sapiens
  Aggrecan Link domain 2
EVFYATSPEKFTFQEAANECRRLGARLATTGQLYLAWQAGMDMCSAGWLADRSVRYPISKARPNCGGNLLGVRTVYVHANQTGYPDPSSRYDAICY

SEQ ID NO: 387 - protein, 95 aa, Homo sapiens
  Aggrecan Link domain 3
VVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCF

SEQ ID NO: 388 - protein, 96 aa, Homo sapiens
  Aggrecan Link domain 4
EVFFATRLEQFTFQEALEFCESHNATLATTGQLYAAWSRGLDKCYAGWLADGSLRYPIVTPRPACGGDKPGVRTVYLYPNQTGLPDPLSRHHAFCF

SEQ ID NO: 389 - protein, 95 aa, Homo sapiens
  Brevican Link domain 1
VVFLYREGSARYAFSFSGAQEACARIGAHIATPEQLYAAYLGGYEQCDAGWLSDQTVRYPIQTPREACYGDMDGFPGVRNYGVVDPDDLYDVYCY

SEQ ID NO: 390 - protein, 96 aa, Homo sapiens
  Brevican Link domain 2
ELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCF

SEQ ID NO: 391 - protein, 95 aa, Homo sapiens
  Versican Link domain 1
VVFHYRAATSRYTLNFEAAQKACLDVGAVIATPEQLFAAYEDGFEQCDAGWLADQTVRYPIRAPRVGCYGDKMGKAGVRTYGFRSPQETYDVYCY

SEQ ID NO: 392 - protein, 96 aa, Homo sapiens
  Versican Link domain 2
DVFHLTVPSKFTFEEAAKECENQDARLATVGELQAAWRNGFDQCDYGWLSDASVRHPVTVARAQCGGGLLGVRTLYRFENQTGFPPPDSRFDAYCF

SEQ ID NO: 393 - protein, 95 aa, Homo sapiens
  Neurocan Link domain 1
VVFHYRSARDRYALTFAEAQEACRLSSAIIAAPRHLQAAFEDGFDNCDAGWLSDRTVRYPITQSRPGCYGDRSSLPGVRSYGRRNPQELYDVYCF

SEQ ID NO: 394 - protein, 96 aa, Homo sapiens
  Neurocan Link domain 2
EVFYVGPARRLTLAGARAQCRRQGAALASVGQLHLAWHEGLDQCDPGWLADGSVRYPIQTPRRRCGGPAPGVRTVYRFANRTGFPSPAERFDAYCF

SEQ ID NO: 395 - DNA, 20 bp, Artificial Sequence
  HAS1 Forward primer
tacaaccagaagttcctggg

SEQ ID NO: 396 - DNA, 20 bp, Artificial Sequence
  HAS1 Reverse primer
ctggaggtgtacttggtagc

SEQ ID NO: 397 - DNA, 21 bp, Artificial Sequence
  HAS2 forward primer
gtatcagtttggtttacaatc

SEQ ID NO: 398 - DNA, 21 bp, Artificial Sequence
  HAS2 reverse primer
gcaccatgtcatattgttgtc

SEQ ID NO: 399 - DNA, 20 bp, Artificial Sequence
  HAS3 forward primer
cttaagggttgcttgcttgc

SEQ ID NO: 400 - DNA, 20 bp, Artificial Sequence
  HAS3 reverse primer
gttcgtgggagatgaaggaa

SEQ ID NO: 401 - DNA, 20 bp, Artificial Sequence
  HYAL1 forward primer
gtgctgccctatgtccagat

SEQ ID NO: 402 - DNA, 20 bp, Artificial Sequence
  HYAL1 reverse primer
attttcccagctcacccaga

SEQ ID NO: 403 - DNA, 19 bp, Artificial Sequence
  HYAL2 forward primer
tctaccattggcgagagtg

SEQ ID NO: 404 - DNA, 18 bp, Artificial Sequence
  HYAL2 reverse primer
gcagccgtgtcaggtaat

SEQ ID NO: 405 - DNA, 20 bp, Artificial Sequence
  GAPDH forward primer
tgcaccaccaactgcttagc

SEQ ID NO: 406 - DNA, 21 bp, Artificial Sequence
  GAPDH reverse primer
ggcatggactgtggtcatgag

SEQ ID NO: 407 - protein, 277 aa, Homo sapiens [sequence omitted]

SEQ ID NO: 408 - protein, 277 aa, Pan troglodytes
  chimpanzee TSG-6 protein
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGVRLNRSERWDAYCYNPHAKECGGVFTDPKRIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 409 - protein, 277 aa, Equus caballus
  horse TSG-6 protein
MIILIYVLVLLWEEAHGWGFKNGIFHNSIWLEQAAGVYHREARSGKYKLTYAEAKAVCEYEGGHLATYKQLEAARKIGFHVCAAGWMAKGRVGYPIVKPGPNCGFGKTGIIDYGIRLNRSERWDAYCYNPHAKECGGIFTDTKRIFKSPGFPNEYDDNQVCYWHIRLKYGQRIHLSFLDFDLEDDTGCLADYVEIYDSYDDVHGFVGRYCGDELPEDIISTGNVMTLKFLSDASVTAGGFQIKYVAVDPPSKPSQGKNTSTTSTGNKSFLAPSFTHL

SEQ ID NO: 410 - protein, 277 aa, Canis lupis
  dog TSG-6 protein
MIIFISLFVLLWEEAHGWGFNNGIFHNSIWLEQAAGVYHREARSGRYRLTYAEAKAVCEFEGGRLATYKQLEAARKIGFHVCAAGWMAKGRVGYPIVKPGPNCGFGKTGIIDYGVRLNRSERWDAYCYNPHAKECGGVFTDPKRIFKSPGFPNEYDDNQICYWHIRVKYGQRVHLSFLDFDLEDDPACLADYVEIYDSYDDVHGFVGRYCGDELPEDIISTGNVMTLKFLSDASVTAGGFQIKYIAVDPLSKSSQGKNTSTTSTGNKNFLAGRFSHL

SEQ ID NO: 411 - protein, 275 aa, Mus musculus; identical to SEQ ID NO: 252
  mouse TSG-6 protein

SEQ ID NO: 412 - protein, 275 aa, Gallus gallus
  chicken TSG-6 protein
MIALIFFSALLWDEAQAWGFKDGVLHNSIWLERAAGVYHRESRSGKYQLTYAEAKAVCEYEGGHLATYQQLEAARKIGFHVCAAGWMAKGRVGYPIVKAGANCGFGRTGIVDYGIRLNRSERWDAYCYNPNGKECGGVFTDSKHVFKSPGYPNEYENDQICYWHIRVKYGQRIHLQFLEFDVEDDTACMADYLEIYDSYDDINGFVGRFCGDELPDDIISTGNVMTLKFLSDASVTAGGFQIRYVTIDLPSKAGDGKNTTSQGKANFLSGKFGIM

SEQ ID NO: 413 - protein, 266 aa, Xenopus laevis
  African clawed frog TSG-6 protein
MKTMIFLVLVFLDETFGWGFKNGVLHNSIWLEQAAGVYHRESRNGKYKLTYREAKAVCEYEGGRLATYEQLEAARQIGFHVCAAGWLHKGRVGYPIVKPTFNCGFGKKGIIDYGFRLNKSERWDAYCYNPHAKECGGVLTEQERIIKSPGYPDHYENDQICYWHIRVNYGQRIFIEFLDLDIEEDIDCLSDYFEIYDSYDDLHGLVGRYCGYELPDRIISTGNVMTLKFLSDGSVIGGGFQIKYTAVDSERNETNASSEPYNEFEY

SEQ ID NO: 414 - protein, 271 aa, Danio rerio
  zebrafish TSG-6 protein
MSHCGLRAMRALTAVFGVLIVLKETEAWGYKNGILHNSIWLEQAAGVYHRESRKGRYQLTYKEAKAVCNFEGGTLATFDQLEAARQIGFHVCAAGWLDKGRVGYPIVKAGSNCGFGKVGIIDYGYRLNKSERWDVYCYNPVAKECGGVHTDPEKVLVSPGYPDEYQDEQICYWHIRVRFGHRIRLHFLDFDIEEDTDCLSDHLEIYDSYDDVSGFVGRYCGDQLPDDFISTGNVMTLKFLSDSSVTAGGFKLQYISVNSSQLFDLLADSFS

SEQ ID NO: 415 - protein, 14 aa, Artificial Sequence
  V5 tag
GKPIPNPLLGLDST

SEQ ID NO: 416 - protein, 95 aa, Homo sapiens
  TSG-6 link domain aa 35-129 variant K21A/K35A/K42A
AGVYHREARSGKYKLTYAEAAAVCEFEGGHLATYAQLEAARAIGFHVCAAGWMAKGRVGYPIVKPGPNCGFGKTGIIDYGIRLNRSERWDAYCYN

SEQ ID NO: 417 - protein, 94 aa, Homo sapeins
  TSG-6 link domain aa 36-129
GVYHREARSGKYKLTYAEAKAVCEFEGGHLATYKQLEAARKIGFHVCAAGWMAKGRVGYPIVKPGPNCGFGKTGIIDYGIRLNRSERWDAYCYN

SEQ ID NO: 418 - protein, 97 aa, Homo sapiens
  TSG-6 link domain aa 36-132
GVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 419 - protein, 10 aa, Artificial Sequence
  c-myc Tag
EQKLISEEDL

SEQ ID NO: 420 - protein, 9 aa, Artificial Sequence
  Hemagglutinin tag
YPYDVPDYA

SEQ ID NO: 421 - protein, 11 aa, Artificial Sequence
  VSV-G Tag
YTDIEMNRLGK

SEQ ID NO: 422 - protein, 11 aa, Artificial Sequence
  HSV Tag
QPELAPEDPED

SEQ ID NO: 423 - protein, 308 aa, Homo sapiens
  Aggrecan G1 domain
TSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGE

SEQ ID NO: 424 - protein, 306 aa, Homo sapiens
  Bervican G1 domain
GALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDS

SEQ ID NO: 425 - protein, 312 aa, Homo sapiens
  Versican G1 domain
GKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPK

SEQ ID NO: 426 - protein, 307 aa, Homo sapiens
  Neurocan G1 domain
ELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAH

SEQ ID NO: 427 - DNA, 1662 bp, Homo sapiens
  human hyaluronan synthase 3 cDNA, transcript variant 1
atgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctgtttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtag

SEQ ID NO: 428 - DNA, 10836 bp, Artificial Sequence
  pLV-EF1a-hHAS3-IRES-Hyg
aagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgatgcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgatatcctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctctagacccgggccaccatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctgtttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtagacgcgtctccggcctagggataacagggtaatccgctagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacactagagatccaccggtcgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataggcggccgcgtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgc

The invention claimed is:

1. A method of treating a subject having a hypoxia-related disease or condition, comprising:
 a) measuring the level or amount of hyaluronan (HA) in a sample from a subject, whereby if the HA is at or above a predetermined level, the subject is susceptible to treatment with a hypoxia-activated agent, wherein:
 the HA is measured by detecting binding of a HA-binding protein (HABP) to the sample, and
 the HABP comprises a Tumor necrosis factor-Stimulated Gene-6 (TSG-6) link module (LM) or a sufficient portion thereof that specifically binds to HA;
 b) selecting a susceptible subject for treatment with a hyaluronidase and a hypoxia-activated agent; and
 c) administering a soluble hyaluronidase and a therapeutically effective amount of a hypoxia-activated agent to the subject, wherein the soluble hyaluronidase and the hypoxia-activated agent are administered simultaneously, sequentially or intermittently in any order, to thereby treat the subject.

2. The method of claim 1, wherein the hypoxia-related disease or condition is a hyperproliferative disease or condition.

3. The method of claim 1, wherein the hypoxia-related disease or condition is cancer, angiogenesis or an angiogenesis related disorder.

4. The method of claim 1, wherein the sample is selected from among a tissue, cell and bodily fluid.

5. The method of claim 1, wherein the sample is from a tumor.

6. The method of claim 1, wherein the predetermined level is the level or amount of the HA in a control or reference sample.

7. The method of claim 6, wherein the control or reference sample is selected from among:
 a) an analogous sample from a subject who does not have a hypoxia-related disease or condition;
 b) an analogous sample from a subject known to express low hyaluronan in the sample; and
 c) a cell line.

8. The method of claim 1, wherein:
 the predetermined level is the mean or median level or amount of HA in a sample from a subject who does not have a hypoxia-related disease or condition; or the predetermined level is the mean or median level or amount of HA in a sample from a subject known to have a hypoxia-related disease or condition.

9. The method of claim 1, wherein the subject is selected and treated if the level or amount is elevated at least 0.5-fold, 1-fold, 2-fold, 3-fold, 4-fold, 5-fold, 6-fold, 7-fold, 8-fold, 9-fold, 10-fold or more compared to the predetermined level.

10. The method of claim 1, wherein the sample is a bodily fluid that is plasma and the predetermined level of HA is at least or above 0.010 μg HA/mL.

11. The method of claim 1, wherein the sample is a tumor and a subject is selected for treatment if moderate to high hyaluronan is measured.

12. The method of claim 11, wherein moderate to high hyaluronan is measured if hyaluronan is present on at least 10%, 10% to 25%, or greater than 25% of the tumoral area.

13. The method of claim 1, wherein the TSG-6-LM has the sequence of amino acids set forth in SEQ ID NOS: 207, 360, 417 or 418, or a sequence of amino acids comprising at least 85% amino acid sequence identity to the sequence of amino acids set forth in SEQ ID NOS: 207, 360, 417 or 418 and specifically binds HA.

14. The method of claim 1, wherein the TSG-6 link module is modified to reduce or eliminate binding to heparin.

15. The method of claim 14, wherein the TSG-6 link module comprises an amino acid replacement at an amino acid position corresponding to amino acid residue 20, 34, 41, 54, 56, 72 or 84 set forth in SEQ ID NO:360, whereby a corresponding amino acid residue is identified by alignment to a TSG-6-LM set forth in SEQ ID NO:360.

16. The method of claim 15, wherein TSG-6 link module comprises an amino acid replacement corresponding to amino acid replacement K20A, K34A and/or K41A in a TSG-6-LM set forth in SEQ ID NO:360 or the replacement at the corresponding residue in another TSG-6-LM.

17. The method of claim 16, wherein the HABP comprises a link module set forth in SEQ ID NO:361 or 416 or a sequence of amino acids comprising at least 85% amino acid sequence identity to the sequence of amino acids set forth in SEQ ID NO:361 or 416 that specifically binds HA.

18. The method of claim 1, wherein the HABP is a multimer comprising a first HA-binding domain linked directly or indirectly via a linker to a multimerization domain and a second HA-binding domain linked directly or indirectly via a linker to a multimerization domain and wherein the first and second HA-binding domain each is a TSG-6 link module (LM), a variant thereof or a sufficient portion thereof that specifically binds to HA.

19. The method of claim 18, wherein the TSG-6-LM comprises the sequence of amino acids set forth in SEQ ID NOS: 207, 360, 361, 416, 417 or 418 or a sequence of amino acids comprising at least 85% amino acid sequence identity to the sequence of amino acids set forth in SEQ ID NOS: 207, 360, 361, 416, 417 or 418 that specifically binds HA.

20. The method of claim 18, wherein the multimerization domain is selected from among an immunoglobulin constant region (Fc), a leucine zipper, complementary hydrophobic regions, complementary hydrophilic regions, compatible protein-protein interaction domains, free thiols that forms an intermolecular disulfide bond between two molecules, and a protuberance-into-cavity and a compensatory cavity of identical or similar size that form stable multimers.

21. The method of claim 18, wherein the multimerization domain is an Fc domain or a variant thereof that effects multimerization.

22. The method of claim 21, wherein the HABP is a fusion protein that contains a TSG-6 link module and an immunoglobulin Fc domain.

23. The method of claim 22, wherein the HABP is TSG-6-LM-Fc and comprises the sequence of amino acids set forth as amino acids 21-349 of SEQ ID NO:212 or 215 or a sequence of amino acids that exhibits at least 85% sequence identity to amino acids 21-349 of SEQ ID NO: 212 or 215 and specifically binds HA.

24. The method of claim 22, wherein the HABP is TSG-6-LM-Fc and the polypeptide is encoded by a nucleic acid molecule that encodes the sequence of amino acids set forth in SEQ ID NO:212 or 215 or a sequence of amino acids that exhibits at least 85% amino acid sequence identity to SEQ ID NO:212 or 215 and specifically binds HA.

25. The method of claim 1, wherein the hypoxia-activated agent is a hypoxia-activated prodrug.

26. The method of claim 25, wherein the hypoxia-activated prodrug comprises a bioreductive group selected from among a quinone, aromatic N-oxide, aliphatic N-oxide, nitroheterocyclic compound and transition-metal complex.

27. The method of claim 25, wherein the hypoxia-activated prodrug comprises an anti-neoplastic agent.

28. The method of claim 27, wherein the anti-neoplastic agent is a pan-Her inhibitor.

29. The method of claim 25, wherein the hypoxia-activated prodrug is selected from among a mitomycin C, porfiromycin, cyclopropamitosene, diaziquone, streptonigrin, EO9, RH1, tirapazamine, CEN-209, AQ4N, Nitracrine N-Oxide, PR-104, SN28343, SN29303, SN29730, KS119W, NLCQ-1, RSU1069, RB6145, CB1954, SN23862, SN24771, TH-281, TH-308, TH-302, TH1332, TH1431, SN29966, SN32807, PR-509 or PR-610 and derivatives or analogs thereof.

30. The method of claim 25, wherein the hypoxia-activated prodrug is a conjugate comprising a hypoxia-activated prodrug linked directly or indirectly to a biomacromolecule that targets to a tumor.

31. The method of claim 30, wherein the biomacromolecule is selected from among apo-transferrin, Fe-transferrin, Ru-transferrin, Ti-transferrin, Ga-transferrin, Pt-transferrin, somatostatin, epidermal growth factor, folic acid and transcobalamin.

32. The method of claim 2, wherein the hyperproliferative disease is a cancer.

33. The method of claim 32, wherein the cancer is a tumor or a solid tumor.

34. The method of claim 32, wherein the disease or condition is cancer selected from among any one or more of breast cancer, pancreatic cancer, ovarian cancer, colon cancer, lung cancer, non-small cell lung cancer, in situ carcinoma (ISC), squamous cell carcinoma (SCC), thyroid cancer, cervical cancer, uterine cancer, prostate cancer, testicular cancer, brain cancer, bladder cancer, stomach cancer, hepatoma, melanoma, glioma, retinoblastoma, mesothelioma, myeloma, lymphoma, and leukemia.

35. The method of claim 1, comprising administering a corticosteroid prior to administration of the soluble hyaluronidase or after administration of the soluble hyaluronidase, wherein the corticosteroid is administered in an amount sufficient to ameliorate an adverse effect in the subject from the administered hyaluronan degrading enzyme.

36. The method of claim 1, wherein the subject is a human.

37. The method of claim 1, wherein the soluble hyaluronidase is a human hyaluronidase.

38. The method of claim 1, wherein the soluble hyaluronidase is a PH20 hyaluronidase.

39. The method of claim 38, wherein the hyaluronidase is bovine PH20, ovine PH20 or a soluble human PH20 that lacks all or a portion of the GPI anchor.

40. The method of claim 39, wherein the PH20 hyaluronidase comprises the sequence of amino acids set forth in any of SEQ ID NOS: 4-9, 47, 48, 150-171 and 183-189 or a sequence of amino acids that exhibits at least 85% sequence identity to any of SEQ ID NOS: 4-9, 47, 48, 150-170 and 183-189 and exhibits hyaluronidase activity.

41. The method of claim 1, wherein the soluble hyaluronidase is modified by conjugation to a polymer.

42. The method of claim 41, wherein the polymer is PEG and the soluble hyaluronidase is PEGylated.

43. The method of claim 42, wherein the soluble hyaluronidase is PEGPH20.

44. The method of claim 40, wherein the hyaluronidase is modified by conjugation to a polymer.

45. The method of claim 44, wherein the polymer is PEG and the soluble hyaluronidase is PEGylated.

46. The method of claim 40, wherein the PH20 hyaluronidase consists of a sequence of amino acids having at least 98% sequence identity to the polypeptides that consist of the sequence of amino acid residues set forth in SEQ ID NO:48.

47. The method of claim 46, wherein the hyaluronidase is modified by conjugation to a polymer.

48. The method of claim 47, wherein the polymer is PEG and the soluble hyaluronidase is PEGylated.

49. The method of claim 48, wherein the HABP comprises a TSG-6-LM multimer.

50. The method of claim 1, further comprising administering a glucocorticoid prior to or after the hyaluronidase.

51. The method of claim 45, further comprising administering a glucocorticoid prior to or after the hyaluronidase.

\* \* \* \* \*